(12) United States Patent
Dalmia et al.

(10) Patent No.: US 7,071,307 B2
(45) Date of Patent: Jul. 4, 2006

(54) NUCLEIC ACIDS AND PROTEINS WITH THIOREDOXIN REDUCTASE ACTIVITY

(75) Inventors: Bipin K. Dalmia, San Diego, CA (US); Steven P. Briggs, Del Mar, CA (US); Greg del Val, San Diego, CA (US); John R. Desjarlais, Pasadena, CA (US); Peter Heifetz, San Diego, CA (US); Peter Luginbuhl, San Diego, CA (US); Umesh Muchhal, West Covina, CA (US)

(73) Assignees: Syngenta Participations AG, Basel (CH); Xencor, Inc., Monrovia, CA (US)

( * ) Notice: Subject to any disclaimer, the term of this patent is extended or adjusted under 35 U.S.C. 154(b) by 384 days.

(21) Appl. No.: 10/141,531

(22) Filed: May 6, 2002

(65) Prior Publication Data

US 2003/0100743 A1    May 29, 2003

Related U.S. Application Data

(60) Provisional application No. 60/289,029, filed on May 4, 2001, provisional application No. 60/370,609, filed on Apr. 5, 2002, provisional application No. 60/376,682, filed on Apr. 29, 2002.

(51) Int. Cl.
*C07K 1/00* (2006.01)

(52) U.S. Cl. .................... 530/350; 530/300

(58) Field of Classification Search ............... 530/350, 530/300; 435/6, 410, 325, 320.1, 252.3; 424/93.2, 200.1; 536/24.3
See application file for complete search history.

(56) References Cited

U.S. PATENT DOCUMENTS 5,952,034 A    9/1999   Buchanan et al.
6,188,965 B1   2/2001   Mayo et al.
6,269,312 B1   7/2001   Mayo et al.
6,380,372 B1   4/2002   Cho et al.
6,403,312 B1   6/2002   Dahiyat et al.
6,708,120 B1   3/2004   Mayo et al.
2001/0032052 A1  10/2001   Mayo et al.
2001/0039480 A1  11/2001   Mayo et al.
2002/0004706 A1  1/2002   Mayo et al.
2002/0037303 A1  3/2002   Deckers et al.
2002/0048772 A1  4/2002   Dahiyat et al.
2002/0090648 A1  7/2002   Dahiyat et al.
2002/0106694 A1  8/2002   Mayo et al.
2003/0049654 A1  3/2003   Dahiyat et al.

(Continued)

FOREIGN PATENT DOCUMENTS

EP    0 974 111 B1    1/2000

(Continued)

OTHER PUBLICATIONS

Alexandrov et al., "*Arabidopsis thaliana* protein fragment SEQ ID NO: 67358", Derwent, Accession No. AAG52945 in the A-GeneSeq database, see amino acids 72-404 of the record.*

(Continued)

*Primary Examiner*—Ardin H. Marschel
*Assistant Examiner*—Jerry Lin
(74) *Attorney, Agent, or Firm*—Robin M. Silva; Timothy A. Worrall

(57) ABSTRACT

The present invention relates to the use of a variety of methods for generating functional thioredoxin reductase variants in which at least one physical, chemical or biological property of the variant is altered in a specific and desired manner when compared to the wild-type protein.

11 Claims, 79 Drawing Sheets

U.S. PATENT DOCUMENTS

| | | |
|---|---|---|
| 2003/0130827 A1 | 7/2003 | Bentzien et al. |
| 2003/0211511 A1 | 11/2003 | Briggs et al. |
| 2004/0043429 A1 | 3/2004 | Dahiyat et al. |
| 2004/0043430 A1 | 3/2004 | Dahiyat et al. |

FOREIGN PATENT DOCUMENTS

| | | | |
|---|---|---|---|
| EP | 1033405 | A2 * | 9/2000 |
| EP | 1 255 209 | A2 | 11/2002 |
| WO | WO 98/47089 | A1 | 10/1998 |
| WO | WO 00/23564 | A2 | 4/2000 |
| WO | WO 00/58352 | A2 | 10/2000 |
| WO | WO 01/59066 | A2 | 8/2001 |
| WO | WO 01/59066 | A3 | 8/2001 |
| WO | WO 02/22527 | A2 | 3/2002 |
| WO | WO 02/29019 | A2 | 4/2002 |
| WO | WO 03/014325 | A2 | 2/2003 |
| WO | WO 03/014325 | A3 | 2/2003 |

OTHER PUBLICATIONS

Alexandrov et al., "*Arabidopsis thaliana* protein fragment SEQ ID NO: 67359", Derwent, Accession No. AAG52946 in the A-GeneSeq database, see amino acids 43-375 of the record.*

Dai et al. "Crystal Structure of *Arabidopsis thaliana* NADPH Dependent Thioredoxin Reductase at 2.5 A Resolution," Journal of Molecular Biology (1996) 264, 1044-1057.*

Banta, S. et al., "Alteration of the specificity of the cofactor-binding pocket of *Corynebacterium* 2,5-diketo-D-gluconic acid reductase A", Protein Engineering, 2002, 2:131-140.

Mittl, P.R. et al., "Anatomy of an engineered NAD-binding site", Protein Science, 1994, 3:1504-1514/.

Mittl, P.R. et al., "Structural differences between wild-type NADP-dependent glutathione reductase form *Escherichia coli* and a redesigned NAD-dependent mutant", J. Mol. Biol., 1993, 231(2):191-195.

Mittl, P.R. et al., "Structure of a glutathione reductase from *Escherichia coli* at 1.86 Å resolution: comparison with the enzyme from human erythrocytes", Protein Science, 1994, 3:799-809.

Reynolds, C. et al., "An NADH-Dependent Bacterial Thioredoxin Reductase-like Protein Conjuction with a Glutaredoxin Homologue Form a Unique Peroxiredoxin (AhpC) Reducing System in *Clostridium pasteurianum*", Biochemistry, 2002, 41:1990-2001.

Scrutton, N.S. et al., "Redesign of the coenzyme specificity of a dehydrogenase by protein engineering", Nature, 1990, 343:38-43.

Wood, Z. et al., "Structure of the Intact AhpF Reveals a Mirrored Thioredoxin-like Active Site and Implies Large Domain Rotations during Catalysis", Biochemistry, 2001, 40:3900-3911.

Jacquot, J., et al., "*Arabidopsis thaliana* NAPHP Thioredoxin Reductase. CDNA Characterization and Expression of the Recombinant Protein in *Escherichia coli*", Journal of Molecular Biology, 1994, 235(4):abstract.

Russel, M., et al., "Sequence of Thioredoxin Reductase from *Escherichia coli* Relationship to Other Flavoprotein Disulfide Oxidoreductases", The Journal of Biological Chemistry, 1988, 263(18):9015-9019.

* cited by examiner

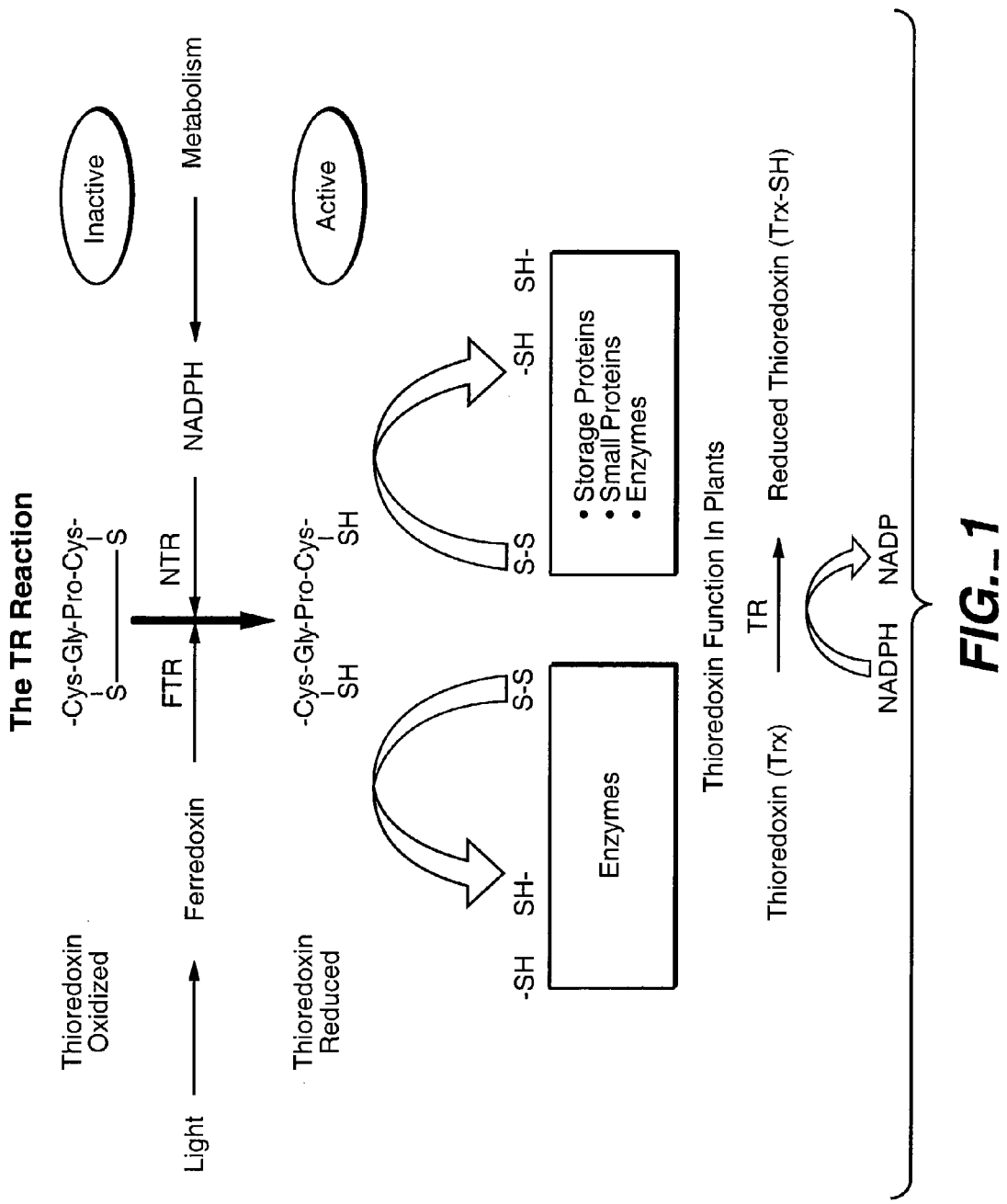
FIG._1

THIOREDOXIN REDUCTASES

| | A1 | A2 | S2 | A3 | A4 | A5 | S3 | A6 | species |
|---|---|---|---|---|---|---|---|---|---|
| Q39243 | S170 | A171 | 17X | H189 | R190 | R191 | 3X | R195 | Arabidopsis |
| Q39242 | S220 | A221 | 17X | H239 | R240 | R241 | 3X | R245 | Arabidopsis |
| O22229 | T240 | A241 | 17X | V259 | R260 | R261 | 3X | R265 | Arabidopsis |
| P09625 | T156 | A157 | 17X | H175 | R176 | R177 | 3X | R181 | E.coli |
| P29509 | S164 | A165 | 17X | V183 | R184 | K185 | 3X | R189 | yeast |
| P38816 | S188 | A189 | 17X | V207 | R208 | K209 | 3X | R213 | yeast |
| Q17745 | V220 | S221 | 17X | V239 | R240 | S241 | 3X | R245 | C.elegans |
| Q9N2K1 | V220 | S221 | 17X | V239 | R240 | S241 | 3X | R245 | C.elegans |
| Q9NJH3 | V362 | S363 | 17X | V381 | R382 | S383 | 3X | R387 | C.elegans |
| Q9VNT5 | V223 | G224 | 17X | V242 | R243 | S244 | 3X | R248 | Drosophila |
| O62768 | V201 | A202 | 17X | V220 | R221 | S222 | 3X | R226 | bovine |
| Q9N2I8 | V216 | A217 | 17X | I235 | R236 | S237 | 3X | R241 | bovine |
| Q16881 | V201 | A202 | 17X | V220 | R221 | S222 | 3X | R226 | human |
| O95840 | V229 | A230 | 17X | M248 | R249 | S250 | 3X | R254 | human |
| Q9UES8 | V201 | A202 | 17X | V220 | R221 | S222 | 3X | R226 | human |
| Q9UH79 | V201 | A202 | 17X | V220 | R221 | S222 | 3X | R226 | human |
| Q9UQU8 | V226 | A227 | 17X | M245 | R246 | S247 | 3X | R251 | human |
| Q9NNW6 | V281 | A282 | 17X | V300 | R301 | S302 | 3X | R306 | human |
| Q9NNW7 | V229 | A230 | 17X | M248 | R249 | S250 | 3X | R254 | human |
| Q9P101 | V279 | A280 | 17X | V298 | R299 | S300 | 3X | R304 | human |
| Q9P2Y0 | V199 | A200 | 17X | M218 | R219 | S220 | 3X | R224 | human |
| Q9H2Z5 | V228 | A229 | 17X | M247 | R248 | S249 | 3X | R253 | human (mito) |
| Q99475 | V253 | A254 | 17X | V272 | R273 | S274 | 3X | R278 | human |
| Q99P49 | V315 | A316 | 17X | V334 | R335 | S336 | 3X | R340 | mouse |
| Q9CSV5 | V201 | A202 | 17X | V220 | R221 | S222 | 3X | R226 | mouse |
| Q9CZE5 | V317 | G318 | 17X | V336 | R337 | S338 | 3X | R342 | mouse |
| Q9JHA7 | V229 | A230 | 17X | M248 | R249 | S250 | 3X | R254 | mouse |
| Q9JLT4 | V233 | A234 | 17X | M252 | R253 | S254 | 3X | R258 | mouse |
| Q9JMH5 | V225 | A226 | 17X | M244 | R245 | S246 | 3X | R250 | mouse |
| Q9JMH6 | V201 | A202 | 17X | V220 | R221 | S222 | 3X | R226 | mouse |
| O89049 | V201 | A202 | 17X | V220 | R221 | S222 | 3X | R226 | rat |
| Q9JKZ4 | V201 | A202 | 17X | V220 | R221 | S222 | 3X | R226 | rat |
| Q9R1I3 | V201 | A202 | 17X | V220 | R221 | S222 | 3X | R226 | rat |
| Q9Z0J5 | V231 | A232 | 17X | M250 | R251 | S252 | 3X | R256 | rat |
| Q9MYY8 | V201 | A202 | 17X | V220 | R221 | S222 | 3X | R226 | pig |

*FIG._2A*

GLUTATHIONE REDUCTASES

| | A1 | A2 | S2 | A3 | A4 | A5 | S3 | A6 | species |
|---|---|---|---|---|---|---|---|---|---|
| P42770 | I271 | A272 | 17X | I290 | R291 | Q292 | 4X | R297 | Arabidopsis |
| P48641 | I214 | A215 | 17X | F233 | R234 | K235 | 4X | R240 | Arabidopsis |
| P48642 | I211 | A212 | 17X | Y230 | R231 | K232 | 4X | R237 | rice |
| O64409 | I83 | A84 | 17X | I102 | R103 | Q104 | 4X | R109 | maize |
| P06715 | I178 | A179 | 17X | V197 | R198 | K199 | 4X | R204 | E.coli |
| O01412 | I182 | A183 | 17X | I201 | R202 | K203 | 4X | W208 | O.volvulus |
| P41921 | I208 | G209 | 17X | I227 | R228 | G229 | 4X | R234 | yeast |
| P91938 | I192 | G193 | 16X | V210 | R211 | S212 | 3X | R216 | Drosophila |
| P00390 | I242 | A243 | 17X | I261 | R262 | H263 | 4X | R268 | human |
| P47791 | I220 | A221 | 17X | I239 | R240 | H241 | 4X | R246 | mouse |
| P70619 | I136 | A137 | 17X | I155 | R156 | H157 | 4X | R162 | rat |

FIG._2B

THIOREDOXIN REDUCTASES CONSENSUS:

| | A1 | A2 | S2 | A3 | A4 | A5 | S3 | A6 |
|---|---|---|---|---|---|---|---|---|
| Arabidopsis | S(T) | A | 17X | H(V) | R | R | 3X | R |
| E.coli | T | A | 17X | H | R | R | 3X | R |
| yeast | S | A | 17X | V | R | K | 3X | R |
| C.elegans | V | S | 17X | V | R | S | 3X | R |
| Drosophila | V | G | 17X | V | R | S | 3X | R |
| animals | V | A(G) | 17X | V/M(I) | R | S | 3X | R |

FIG._2C

GLUTATHIONE REDUCTASES CONSENSUS:

|  | A1 | A2 | S2 | A3 | A4 | A5 | S3 | A6 |
|---|---|---|---|---|---|---|---|---|
| plants | I | A | 17X | I(F,Y) | R | K/Q | 4X | R |
| bacteria | I | A | 17X | V(I) | R | K | 4X | R(W) |
| yeast | I | G | 17X | I | R | G | 4X | R |
| Drosophila | I | G | 16X | V | R | S | 3X | R |
| animals | I | A | 17X | I | R | H | 4X | R |

FIG._2D

COFACTOR SPECIFICITY:

|  | A1 | A2 | S2 | A3 | A4 | A5 | S3 | A6 | species | specificity |
|---|---|---|---|---|---|---|---|---|---|---|
| TR | S | A | 17X | H | R | R | 3X | R | Arabidopsis | NADPH |
| TR | T | A | 17X | H | R | R | 3X | R | E.coli | NADPH |
| GR(wt) | I | A | 3XA13X | V | R | K | H3X | R | E.coli | NADPH |
| GR(mut) | I | G | 3XG13X | E | M | F | D3X | P | E.coli | NADH |
| Cp34 | S | A | 17X | H | Q | F | 3X | Q | C.pasteurianum | NADH |
| AhpF | S | G | 17X | E | F | A | 3X | K | S.typhimurium | NADH |

FIG._2E

SEQ ID NO:1
The N-terminus sequence ($S_1$) of *E. coli* thioredoxin reductase:

GTTKHSKLLILGSGPAGYTAAVYAARANLQPVLITGMEKGGQLTTTTEVENWPGDPNDLTGPLLMERMHEH
ATKFETEIIFDHINKVDLQNRPFRLNGDNGEYTCDALIIATGASARYLGLPSEEAFKGRGVSACATCDGFF
YRNQKVAVIGGGN

FIG._3A

SEQ ID NO:2
The N-terminus sequence ($S_1$) of *Bacillus subtilis* thioredoxin reductase:

SEEKIYDVIIIGAGPAGMTAAVYTSRANLSTLMIERGIPGGQMANTEDVENYPGFESILGPELSNKMFEHA
KKFGAEYAYGDIKEVIDGKEYKVVKAGSKEYKARAVIIAAGAEYKKIGVPGEKELGGRGVSYCAVCDGAFF
KGKELVVVGGGD

FIG._3B

SEQ ID NO:3
The N-terminus sequence ($S_1$) of *Mycobacterium leprae* thioredoxin reductase:

MNTTPSAHETIHEVIVIGSGPAGYTAALYAARAQLTPLVFEGTSFGGALMTTTEVENYPGFRNGITGPELM
DDMREQALRFGAELRTEDVESVSLRGPIKSVVTAEGQTYQARAVILAMGTSVRYLQIPGEQELLGRGVSAC
ATCDGSFFRGQDIAVIGGGD

FIG._3C

SEQ ID NO:4
The N-terminus sequence ($S_1$) of *Sarccharomyces* thioredoxin reductase:

VHNKVTIIGSGPAAHTAAIYLARAEIKPILYEGMMANGIAAGGQLTTTTEIENFPGFPDGLTGSELMDRMR
EQSTKFGTEIITETVSKVDLSSKPFKLWTEFNEDAEPVTTDAIILATGASAKRMHLPGEETYWQKGISACA
VCDGAVPIFRNKPLAVIGGGD

FIG._3D

SEQ ID NO:5
The N-terminus sequence ($S_1$) of *Neurospora crassa* thioredoxin reductase:

MHSKVVIIGSGPAAHTAAIYLARAELKPVLYEGFMANGIAAGGQLTTTTEIENFPGFPDGIMGQELMDKMK
AQSERFGTQIISETVAKVDLSARPFKYATEWSPEEYHTADSIILATGASARRLHLPGEEKYWQNGISACAV
CDGAVPIFRNKHLVVIGGGD

FIG._3E

SEQ ID NO:6
The N-terminus sequence ($S_1$) of *Arabidopsis* thioredoxin reductase:

MNGLETHNTRLCIVGSGPAAHTAAIYAARAELKPLLFEGWMANDIAPGGQLTTTTDVENFPGFPEGILGVE
LTDKFRKQSERFGTTIFTETVTKVDFSSKPFKLFTDSKAILADAVILATGAVAKRLSFVGSGEASGGFWNR
GISACAVCDGAAPIFRNKPLAVIGGGD

FIG._3F

SEQ ID NO:7
The N-terminus sequence ($S_1$) of Human thioredoxin reductase:

MNGPEDLPKSYDYDLIIIGGGSGGLAAAKEAAQYGKKVMVLDFVTPTPLGTRWGLGGTCVNVGCIPKKLMH
QAALLGQALQDSRNYGWKVEETVKHDWDRMIEAVQNHIGSLNWGYRVALREKKVVYENAYGQFIGPHRIKA
TNNKGKEKIYSAESFLIATGERPRYLGIPGDKEYCISSDDLFSLPYCPGKTLVVGASYVALECAGFLAGIGLGV

FIG._3G

SEQ ID NO:8
The first internal sequence ($S_2$) of *E. coli* thioredoxin reductase:

VEEALYLSNIASEVHLI

FIG._3H

SEQ ID NO:9
The first internal sequence ($S_2$) of *Bacillus subtillis* thioredoxin reductase:

VEEGVYLTRFASKVTIV

FIG._3I

SEQ ID NO:10
The first internal sequence ($S_2$) of *Mycobacterium leprae* thioredoxin reductase:

MEEALFLTRFARSVTLV

FIG._3J

SEQ ID NO:11
The first internal sequence ($S_2$) of *Sarccharomyces* thioredoxin reductase:

CEEAQFLTKYGSKVFML

FIG._3K

SEQ ID NO:12
The first internal sequence ($S_2$) of *Neurospora crassa* thioredoxin reductase:

AEEAMYLTKYGSHVTVL

FIG._3L

SEQ ID NO:13
The first internal sequence ($S_2$) of *Arabidopsis* thioredoxin reductase:

MEEANFLTKYGSKVYII

FIG._3M

SEQ ID NO:14
The first internal sequence ($S_2$) of Human thioredoxin reductase:

MVRSILLRGFDQDMANKIGEHMEEHGIKFI

FIG._3N

SEQ ID NO:15
The second internal sequence (S$_3$) of *E. coli* thioredoxin reductase:

DGF

FIG._3O

SEQ ID NO:16
The second internal sequence (S$_3$) of *Bacillus subtillis* thioredoxin reductase:

DKL

FIG._3P

SEQ ID NO:17
The second internal sequence (S$_3$) of *Mycobacterium leprae* thioredoxin reductase:

DEF

FIG._3Q

SEQ ID NO:18
The second internal sequence (S$_3$) of *Sarccharomyces* thioredoxin reductase:

DHL

FIG._3R

SEQ ID NO:19
The second internal sequence (S$_3$) of *Neurospora crassa* thioredoxin reductase:

DKL

FIG._3S

SEQ ID NO:20
The second internal sequence (S$_3$) of *Arabidopsis* thioredoxin reductase:

DAF

FIG._3T

SEQ ID NO:21
The second internal sequence (S$_3$) of Human thioredoxin reductase:

VPI

FIG._3U

SEQ ID NO:22
The C-terminus sequence (S$_4$) of *E. coli* thioredoxin reductase:

AEKILIKRLMDKVENGNIILHTNRTLEEVTGDQMGVTGVRLRDTQNSDNIESLDVAGLFVAIGHSPNTAI
FEGQLELENGYIKVQSGIHGNATQTSIPGVFAAGDVMDHIYRQAITSAGTGCMAALDAERYLDGLADAK

FIG._3V

SEQ ID NO:23
The C-terminus sequence (S$_4$) of *Bacillus subtillis* thioredoxin reductase:

AQSILQARAFDNEKVDFLWNKTVKEIHEENGKVGNVTLVDTVTGEESEFKTDGVFIYIGMLPLSKPFENL
GITNEEGYIETNDRMETKVEGIFAAGDIREKSLRQIVTATGDGSIAAQSVQHYVEELQETLKTLK

FIG._3W

SEQ ID NO:24
The C-terminus sequence (S$_4$) of *Mycobacterium leprae* thioredoxin reductase:

ASKIMLGRARNNDKIKFITNHTVVAVNGYTTVTG-LRLRNTTTGEETTLVVTG

FIG._3X

SEQ ID NO:25
The C-terminus sequence (S$_4$) of *Sarccharomyces* thioredoxin reductase:

ASTIMQKRAEKNEKIEILYNTVALEAKGDGKLLNALRIKNTKKNEETDLPVSGLFYAIGHTPATKIVAGQ
VDTDEAGYIKTVPGSSLTSVPGFFAAGDVQDSKYRQAITSAGSGCMAALDAEKYLTSLE

FIG._3Y

SEQ ID NO:26
The C-terminus sequence (S$_4$) of *Neurospora crassa* thioredoxin reductase:

ASSIMAHRLLNHEKVTVRFNTVGVEVKGDDKGLMSHLVVKDVTTGKEETLEANGLFYAIGHDPATALVKG
QLETDADGYVVTKPGTTLTSVEGVFAAGDVQDKRYRQAITSAGTGCMAALDAEKFLSEHEETPAEHRDTS
AVQGNLSTVKCDYENVPTTVFTPLEYGACGLSEEKAVEKFGEENIEVYHSYFWPLEWTIPSRDNNKCYAK
IICNTKDNERVVGFHVLGPNAGEVTQGFAAALKCGLTKKQLDSTIGIHPVCAEVFTTLSVTKRSGASILQAGC

FIG._3Z

SEQ ID NO:27
The C-terminus sequence (S$_4$) of *Arabidopsis* thioredoxin reductase:

ASKIMQQRALSNPKIDVIWNSSVVEAYGDGERDVLGGLKVKNVVTGDVSDLKVSGLFFAIGHEPATKFLD
GGVELDSDGYVVTKPGTTQTSVPGVFAAGDVQDKKYRQAITAAGTGCMAALDAEHYLQEIGSQQGKSD

FIG._3AA

SEQ ID NO:28
The C-terminus sequence (S$_4$) of Human thioredoxin reductase:

VEQIEAGTPGRLRVVAQSTNSEEIIEGEYNTVMLAIGRDACTRKIGLETVGVKINEKTGKIPVTDEEQTN
VPYIYAIGDILEDKVELTPVAIQAGRLLAQRLYAGVFVAIGHEPRSSLVSDVVDIDPDGYVLVKGRTTST
SMDGVFAAGDLVDRTYRQAITAAGSGCAAAIDAERWLAEHAGSKANETTEETGDVDSTDTTDWSTAMTDA
KNAGVTIEVTDASFFADVLSSNKPVLVDFWATWCGPCKMVAPVLEEIASEQRNQLTVAKLDVDTNPEMAR
EFQVVSIPTMILFQGGQPVKRIVGAKGKAALLRDLSDVVPNLN

FIG._3BB

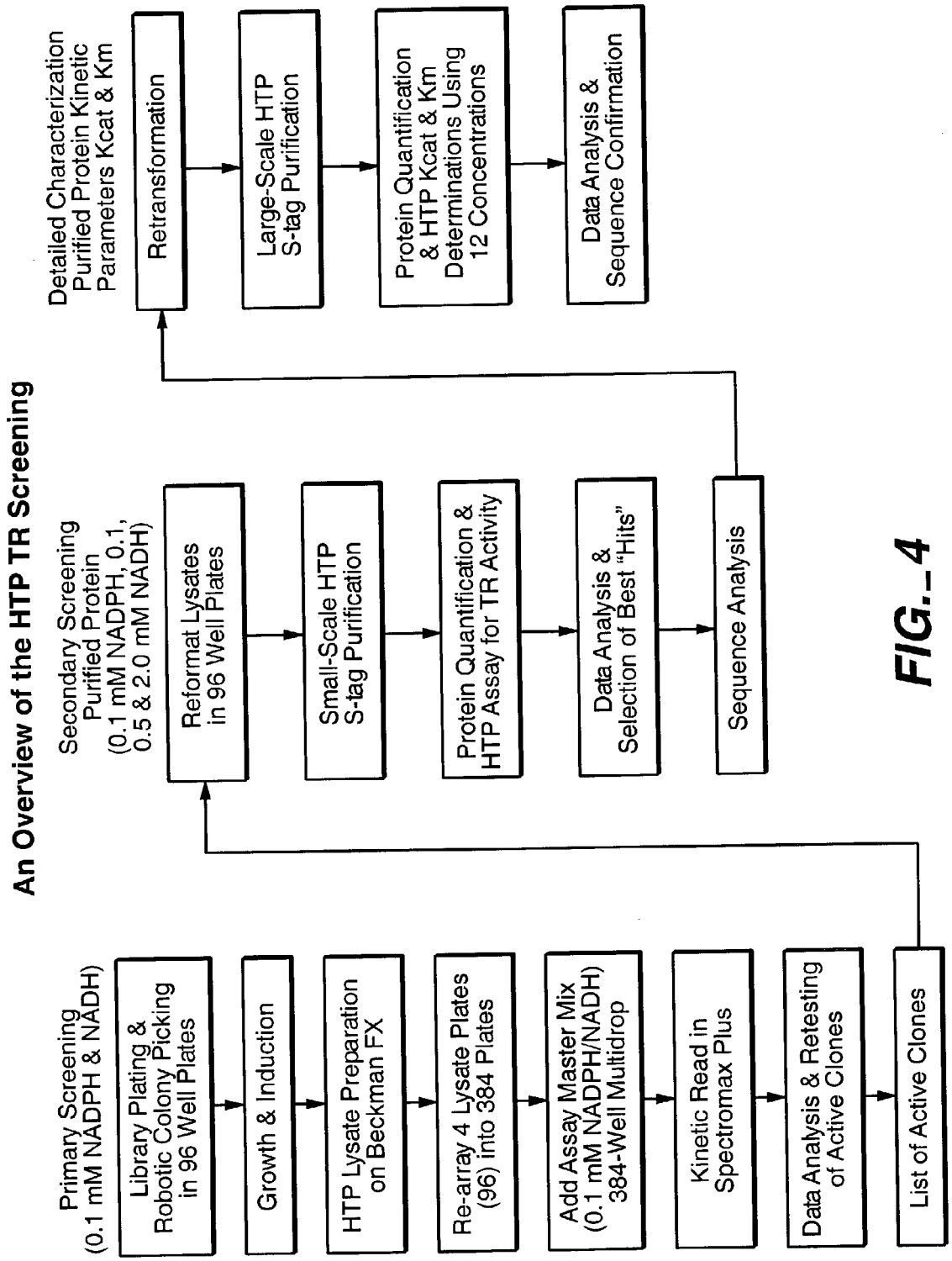
FIG._4

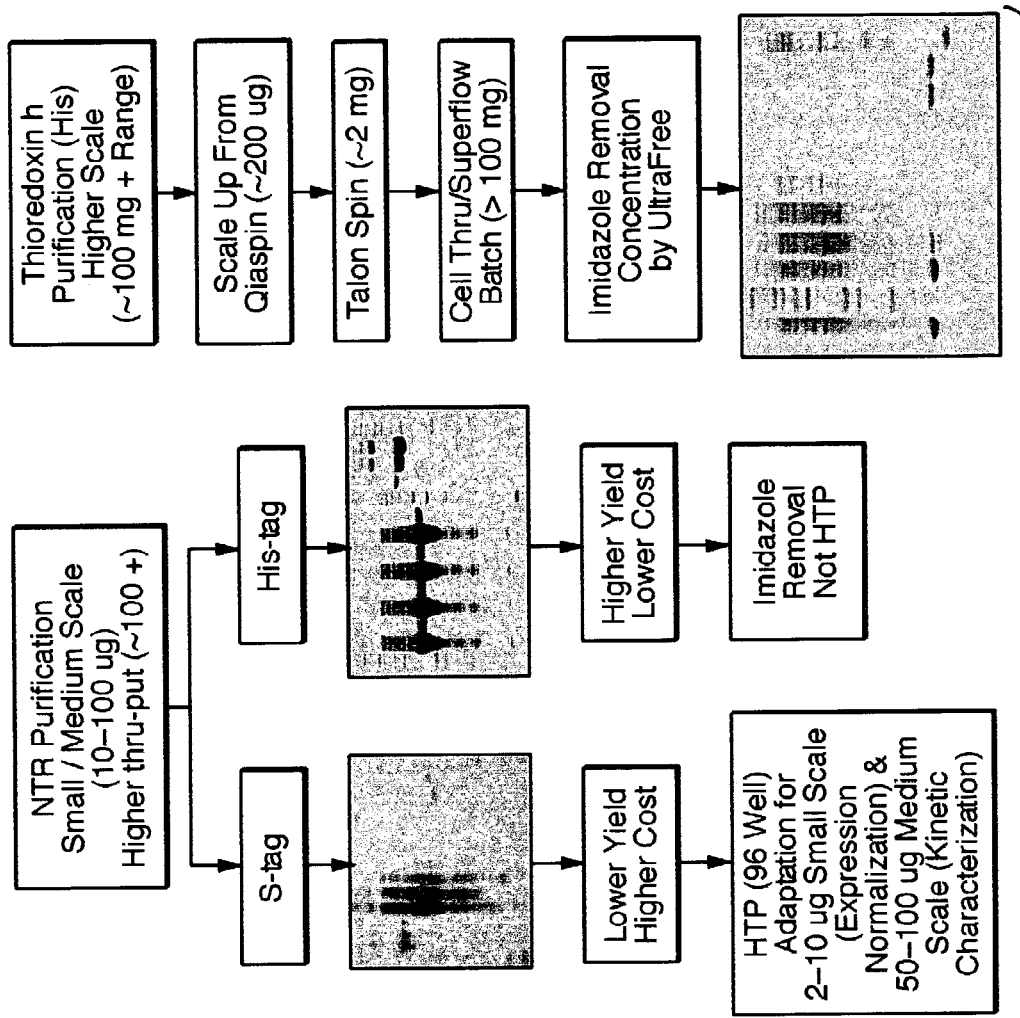
FIG._5

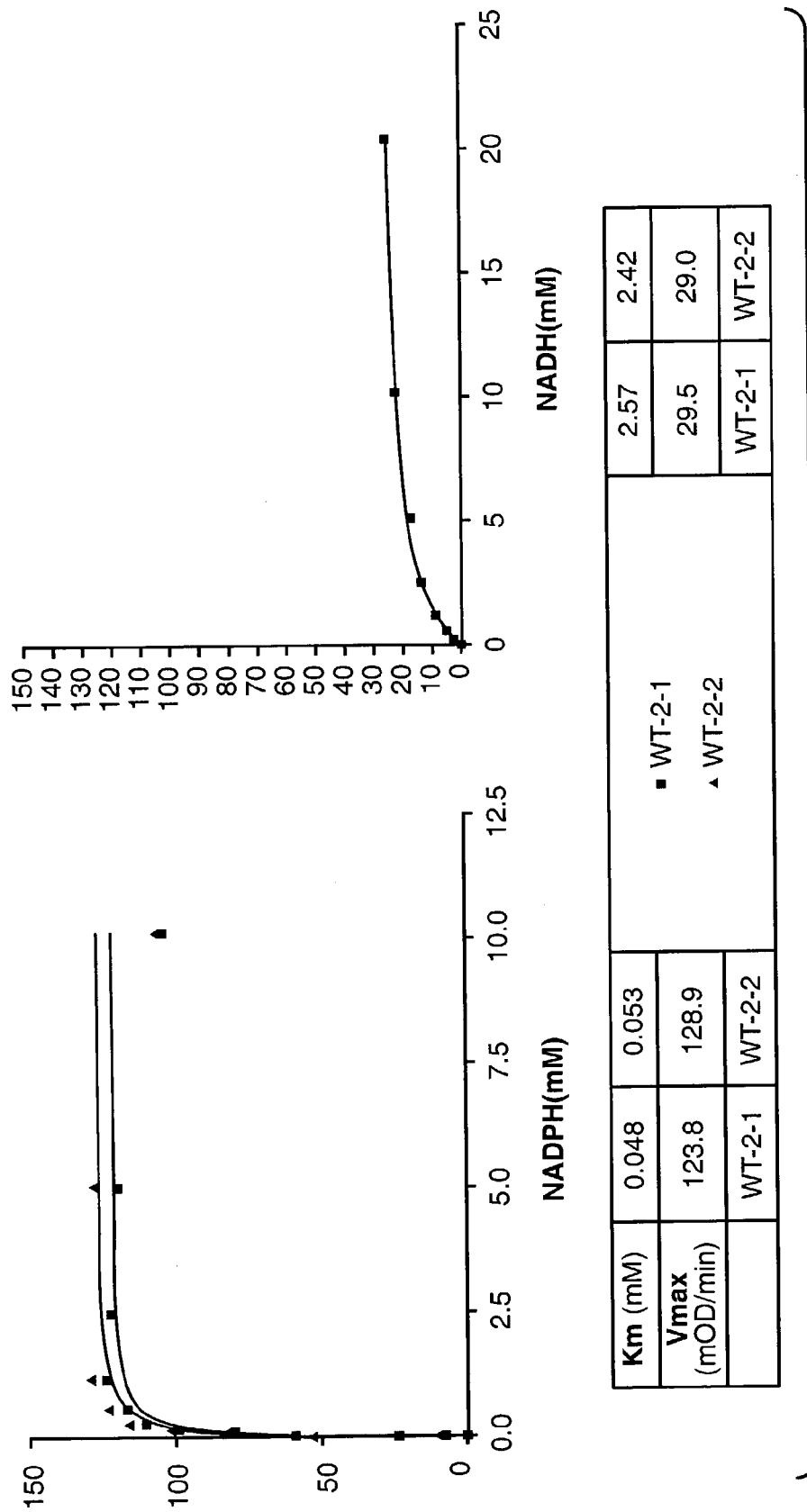
FIG._6

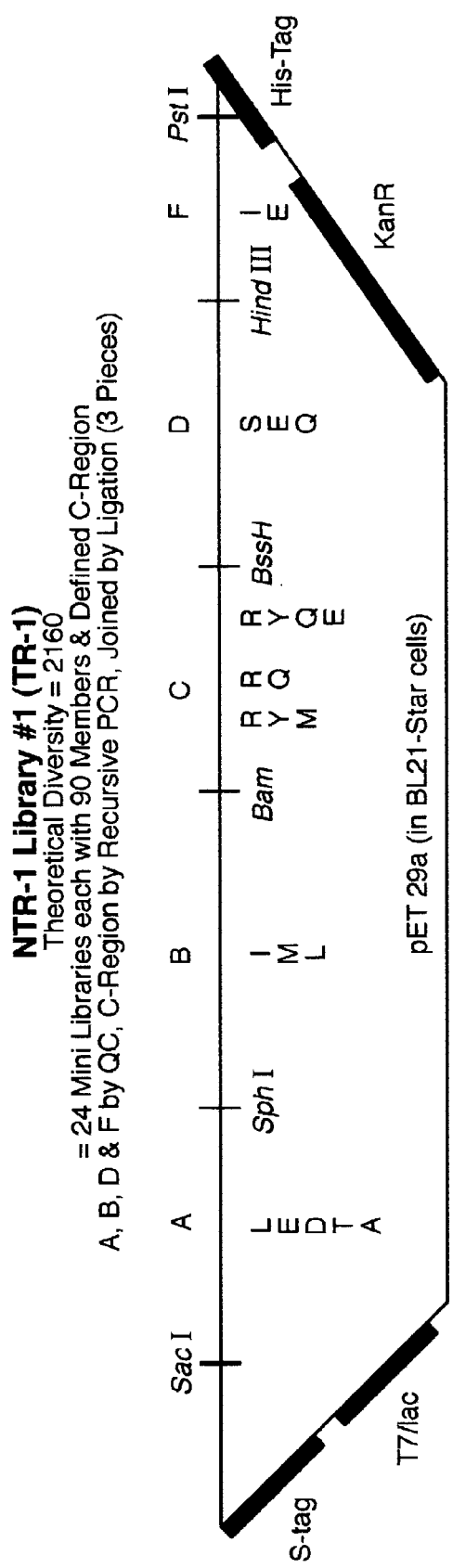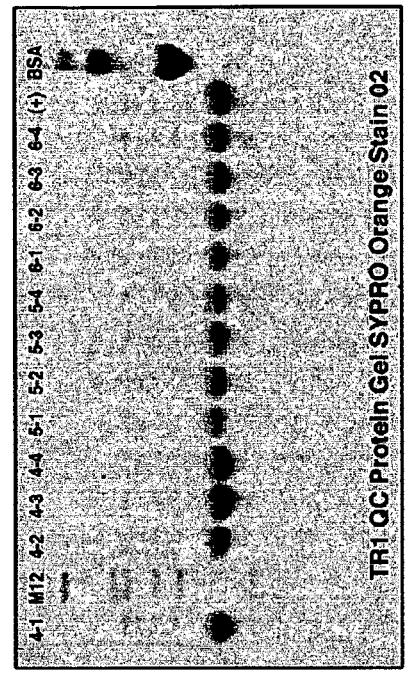
FIG._7

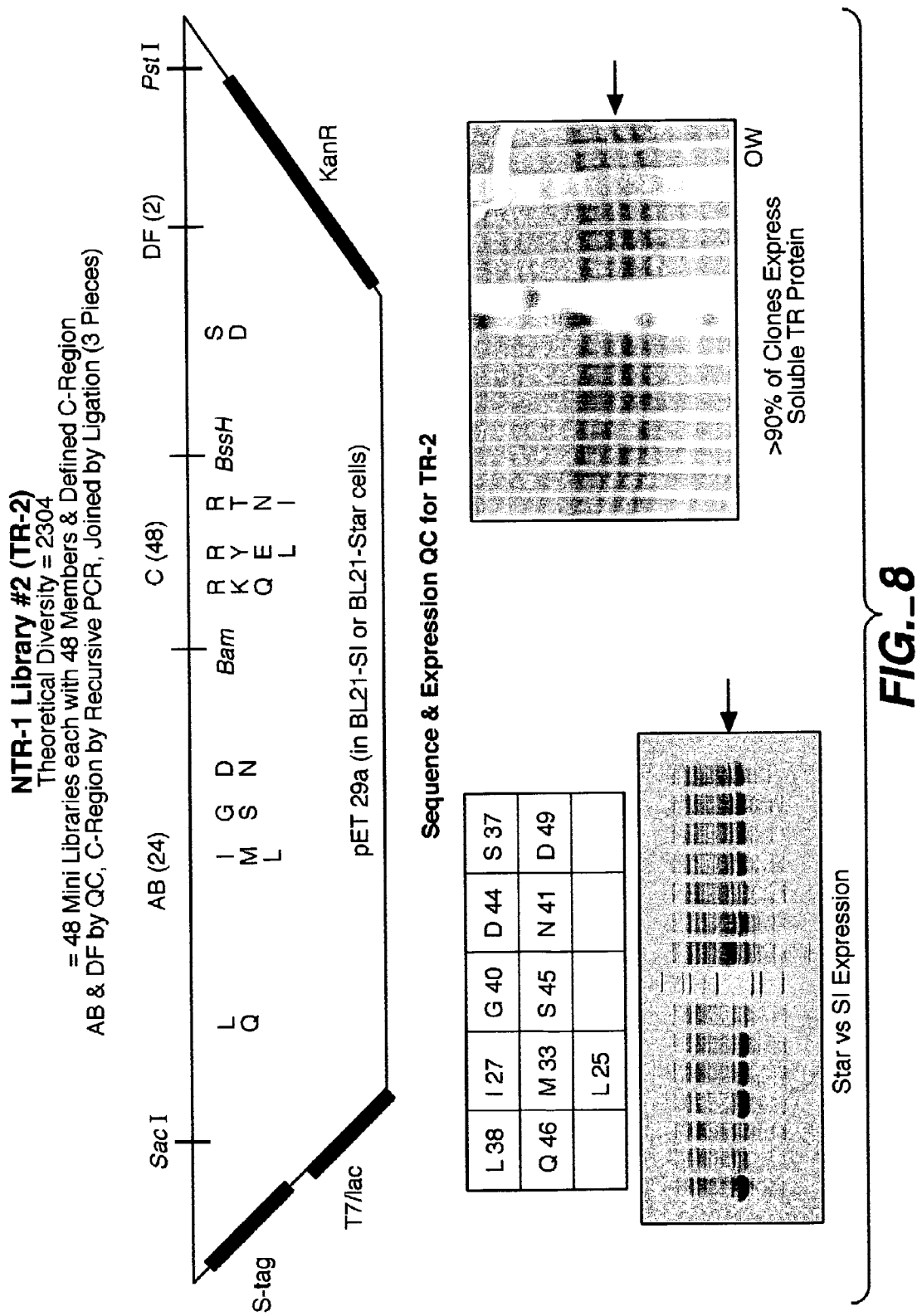
FIG._8

TR Library 1
FIG._9A

TR Library 2
FIG._9B

SacI  BamHI  BssHII  PstI
     AB    C    DF

The TR Libraries.....

| Library | Design | 1st Screen | 2nd Screen | 3rd Rd | "Hits" |
|---|---|---|---|---|---|
| TR-1 (2160) | L I R R R S I<br>E M Y Q Y E E<br>D L M Q Q<br>T<br>A | ~4300 | 267 | 48 | None |
| TR-2 (2304) | L I G D R R R S<br>Q M S N K Y T D<br>L Q E N<br>L I | ~8600 | 569 | 34 | 3 + |
| TR-3 (18) | R R R<br>M F Y D<br>N | 18 | 18 | 18 | 1 + |
| TR-4 (32) | A H R<br>G D F<br>Q C<br>E L | 16 | 16 | 16 | None |

FIG._10

FIG._11A
FIG._11A-1 | FIG._11A-2
FIG._11A-1
Kinetic Parameters of Two PDA™ Designed & WT TR
Altered Co-factor Specificity & Improved Catalytic Efficiency.
Selectivity Improvement (kcat of NADH/NADPH) of 1300%
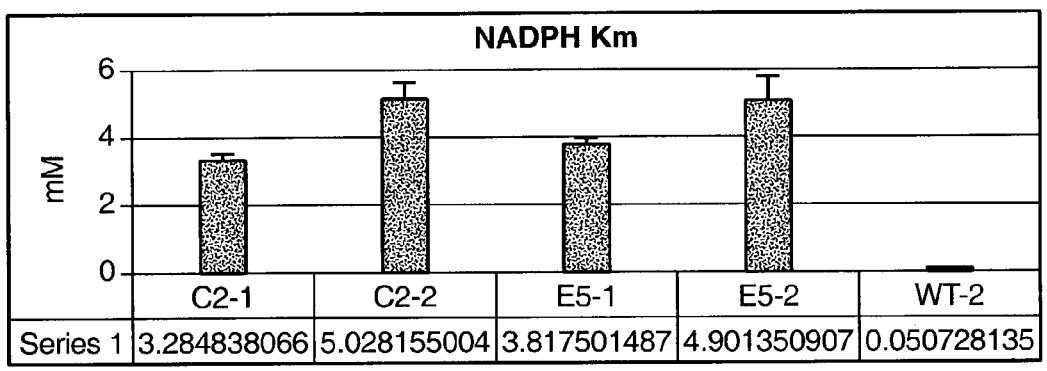
| NADPH Km | | | | | |
|---|---|---|---|---|---|
| | C2-1 | C2-2 | E5-1 | E5-2 | WT-2 |
| Series 1 | 3.284838066 | 5.028155004 | 3.817501487 | 4.901350907 | 0.050728135 |
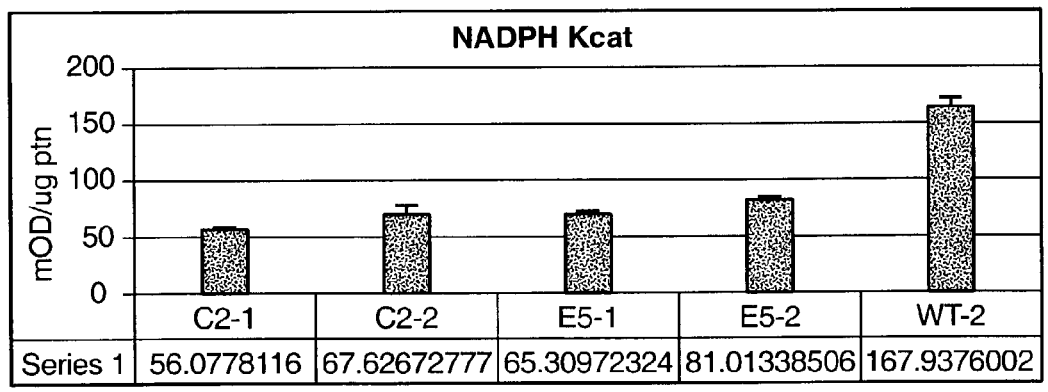
| NADPH Kcat | | | | | |
|---|---|---|---|---|---|
| | C2-1 | C2-2 | E5-1 | E5-2 | WT-2 |
| Series 1 | 56.0778116 | 67.62672777 | 65.30972324 | 81.01338506 | 167.9376002 |
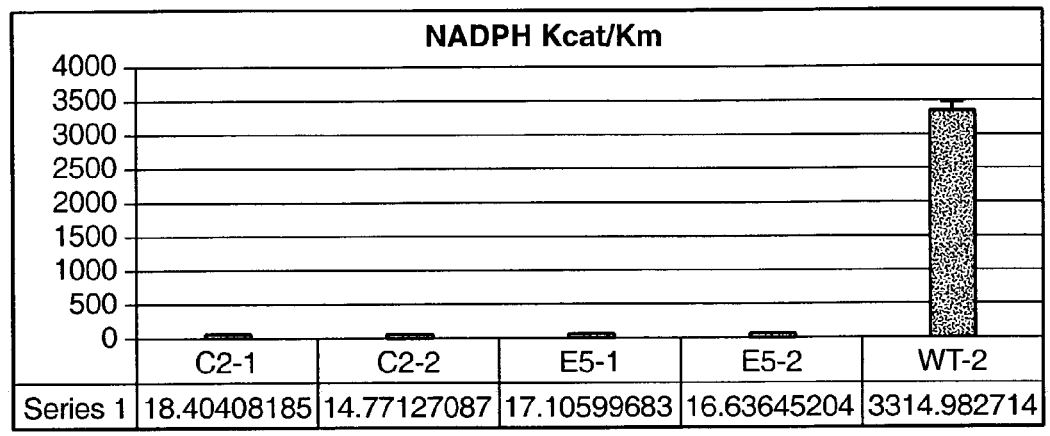
| NADPH Kcat/Km | | | | | |
|---|---|---|---|---|---|
| | C2-1 | C2-2 | E5-1 | E5-2 | WT-2 |
| Series 1 | 18.40408185 | 14.77127087 | 17.10599683 | 16.63645204 | 3314.982714 |
C2 is M-RYN and E5 is L-RYN, WT is I-RRR

FIG._11A-2
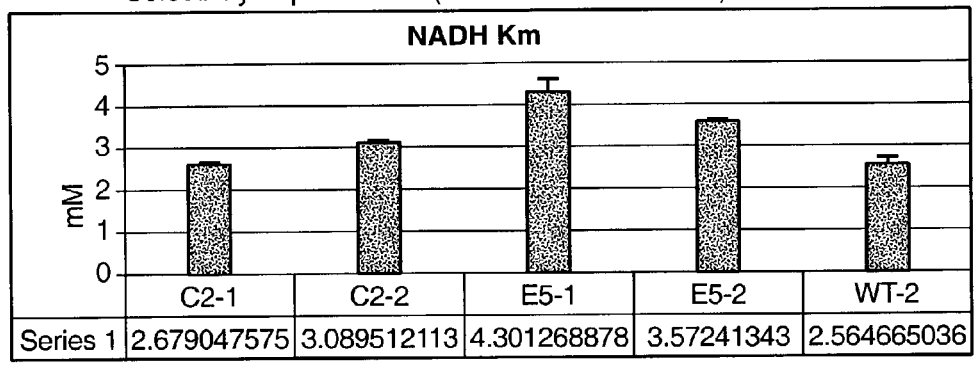
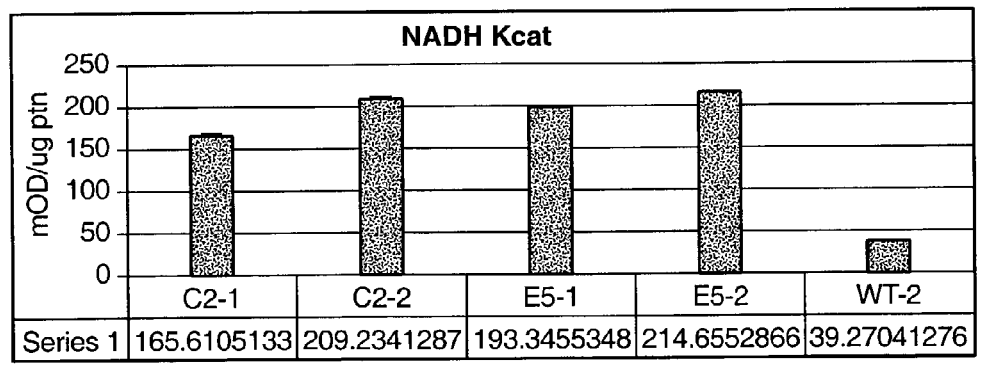
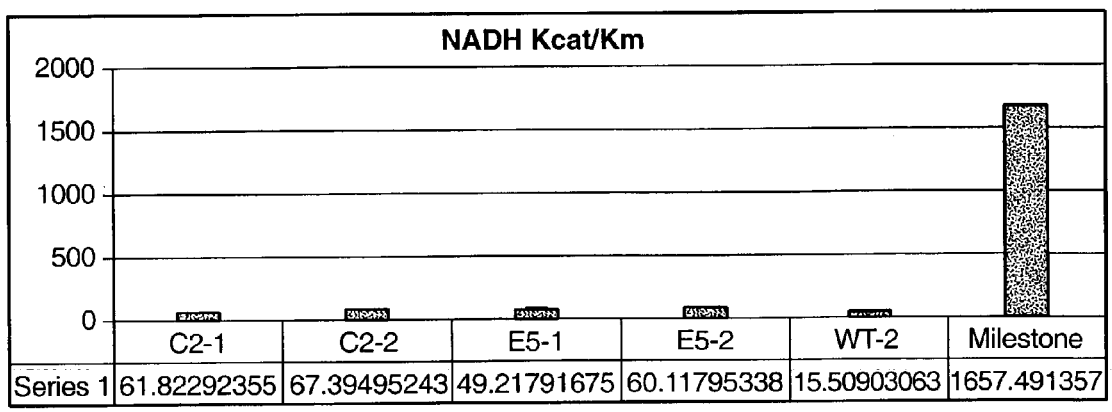
C2 is M-RYN and E5 is L-RYN, WT is I-RRR

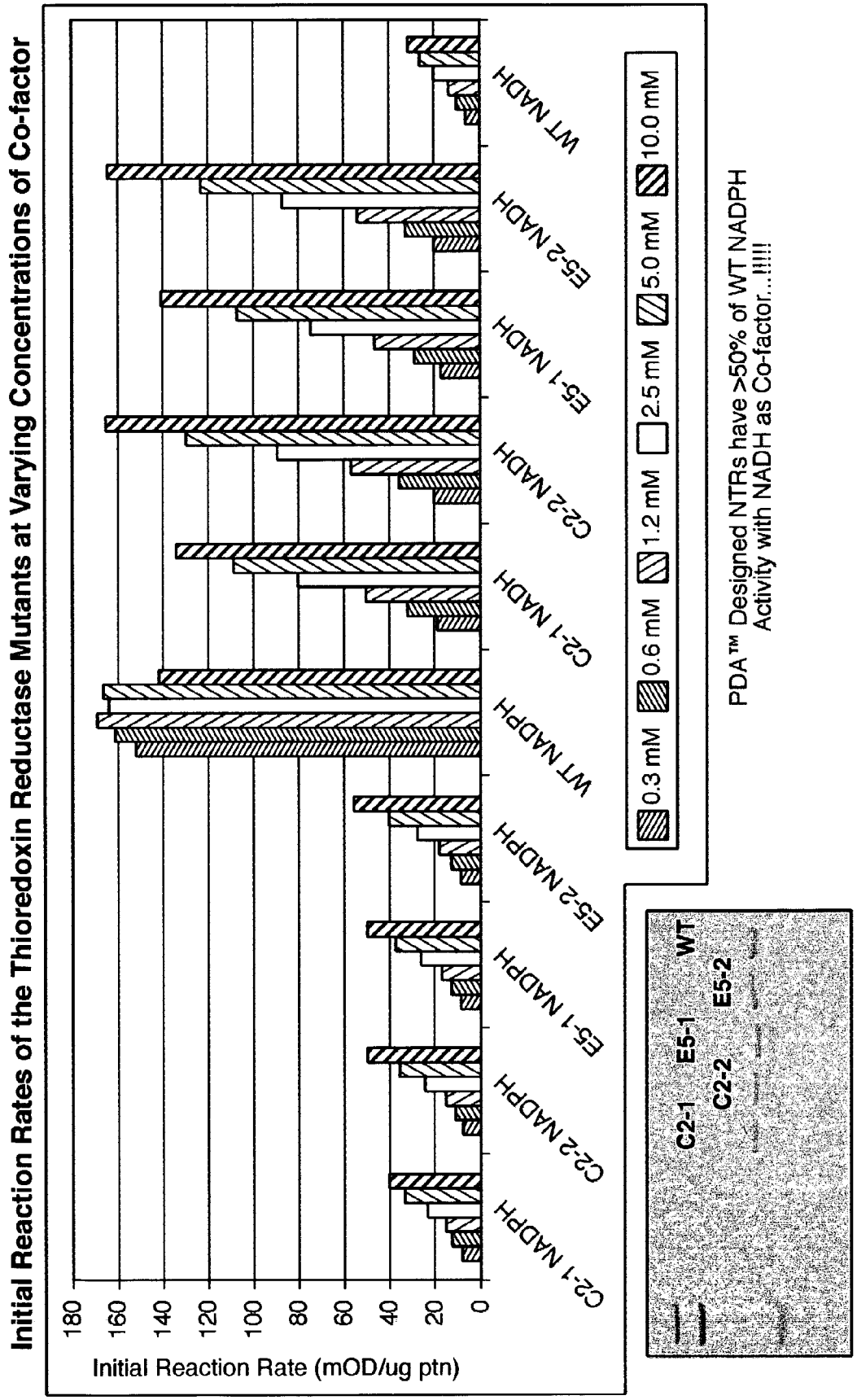
FIG._11B

Best Variants from TR-2 Design

| Sp. Act. 1.2 mM | NADPH | NADH |
|---|---|---|
| RYN | 25 | 106 |
| RFN | 24 | 108 |
| RYN-A | 19 | 97 |
| RFN-A | 15 | 81 |
| WT-RRR | 320 | 24 |
| REN,RLN,RRN | 65, 70, 340 | 65-75 |

FIG._12

Activity Summary of Best "Hits" from New Library Designs

| Sequence | Sample | 0.6mM NADPH | 1.2mM NADPH | 0.6mM NADH | 1.2mM NADH | 1.2mM NADPH | 1.2mM NADH(4) | Protein (ug) | P | H | Sequence | Rank |
|---|---|---|---|---|---|---|---|---|---|---|---|---|
| RYN | 39-2 | 62.79 | 94.89 | 30.71 | 50.84 | 117.35 | 63.67 | 1.52 | | | RYN | |
| WAN | 22-2 | 5.74 | 9.70 | 26.58 | 44.88 | 12.32 | 56.96 | 1.49 | | | WAN | |
| WCT | 13-2 | 5.25 | 9.23 | 31.15 | 54.64 | 10.11 | 65.85 | 1.75 | | | WCT | |
| | 9-2 | | | | | | | | | | WFQ | 2 |
| | 33-2 | | | | | | | | | | WIS | 2 |
| WLG | 28-1 | 11.91 | 19.28 | 50.66 | 86.90 | 25.74 | 103.98 | 1.33 | | | WLG | 4 |
| | 29-2 | | | | | | | | | | WLS | |
| WMD | 4-2 | 0.57 | 0.65 | 34.83 | 59.28 | 1.08 | 77.70 | 1.27 | | | WMD | |
| | 24-1 | | | | | | | | | | WMG | 5 |
| | 16-1 | | | | | | | | | | WMS | 5 |
| WRG | 25-2 | 322.04 | 329.94 | 45.84 | 79.06 | 425.71 | 97.90 | 1.50 | | | WRG | |
| WRM | 26 | 110.82 | 181.98 | 35.42 | 61.25 | 226.34 | 74.69 | 1.46 | | | WRM | |
| | 12-2 | | | | | | | | | | WRS | 6 |
| | 31-1 | | | | | | | | | | WRT | 1 |
| | 31-2 | | | | | | | | | | WRT | 1 |
| WST | 1-2 | 25.14 | 43.73 | 24.63 | 45.29 | 51.42 | 50.19 | 1.38 | | | WST | |
| WTS | 16-2 | 40.95 | 71.02 | 23.51 | 44.73 | 83.42 | 47.16 | 1.34 | | | WTS | |
| | 15-2 | | | | | | | | | | WVG | 7 |
| | 20-2 | | | | | | | | | | WWR | 3 |
| WYS | 8-2 | 31.70 | 58.72 | 36.23 | 67.11 | 72.94 | 75.96 | 1.19 | | | WYS | |
| RYN | 50-1 | 8.16 | 14.27 | 34.91 | 57.12 | 16.92 | 66.01 | 1.30 | | | RYN | |
| RYN | 51-1 | 7.74 | 13.25 | 27.32 | 51.05 | 17.45 | 61.66 | 1.30 | | | RYN | |
| RYN | 52-1 | 9.97 | 16.53 | 33.52 | 57.54 | 21.43 | 77.32 | 1.45 | | | RYN | |
| RRR | 54-2 | 206.76 | 217.81 | 10.09 | 17.18 | 291.75 | 19.00 | 1.38 | | | RRR | |

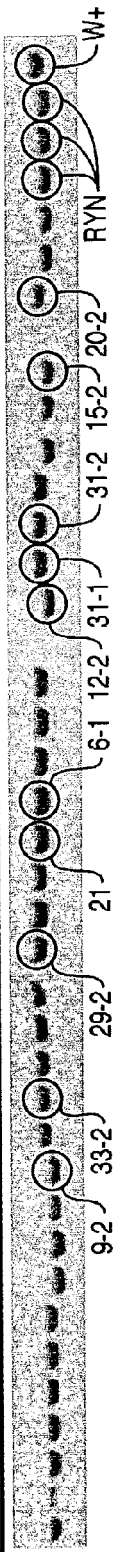

The Best Hits are Defined as having NADH Dependent Activity Better than RYN Variant Identified from TR-2

FIG._13A

Kinetic Parameters Summary of Best "Hits" from New Library Designs

| Sample | Repeat VMAX | KM |
|---|---|---|
| 25-1 | 261.6 | 1.191 |
| 25-2 | 253.1 | 1.154 |
| 31-1 | 339.5 | 0.8293 |
| 31-2 | 363.8 | 0.821 |

| Sample | VMAX | KM | Sequence 2 | Protein in Assa. | Kcat (Vmax/ptn) | Kcat/Km |
|---|---|---|---|---|---|---|
| 38 | 207.1 | 3.749 | RFQ | 1.47 | 141.1068443 | 37.63852876 |
| 42-1 | 69.53 | 4.274 | RLE | 0.63 | 109.6677727 | 25.65928234 |
| 42-2 | 250.1 | 4.227 | RLE | 1.61 | 155.1706003 | 36.70939206 |
| 39-1 | 298.3 | 2.594 | RVN | 1.56 | 191.1796042 | 73.70069554 |
| 39-2 | 314.7 | 2.662 | RVN | 1.52 | 207.1561789 | 77.81975164 |
| 22-1 | 355.8 | 3.461 | WAN | 1.54 | 231.0797326 | 66.76675314 |
| 22-2 | 335.1 | 3.542 | WAN | 1.49 | 225.1612448 | 63.56895675 |
| 13-1 | 446.5 | 3.438 | WCT | 1.86 | 240.2100775 | 69.8691325 |
| 13-2 | 438.9 | 3.47 | WCT | 1.75 | 251.4358726 | 72.45990566 |
| 9-1 | 575.7 | 2.293 | WFQ | 1.20 | 479.717084 | 209.2093694 |
| 9-2 | 659.1 | 2.282 | WFQ | 1.29 | 509.8579299 | 223.4259115 |
| 33-1 | 585.5 | 2.291 | WIS | 1.26 | 464.0063622 | 202.5344226 |
| 33-2 | 530 | 2.352 | WIS | 1.13 | 469.8430657 | 199.7632082 |
| 28-1 | 512.5 | 3.306 | WLG | 1.33 | 384.216821 | 116.2180342 |
| 28-2 | 472.3 | 3.108 | WLG | 1.51 | 313.0195634 | 100.7141453 |
| 29-1 | 533 | 2.038 | WLS | 1.38 | 387.6218563 | 190.1971817 |
| 29-2 | 580.7 | 2.166 | WLS | 1.41 | 413.0366911 | 190.6909931 |
| 4-1 | 417.6 | 4.363 | WMD | 1.57 | 265.8847706 | 60.94081381 |
| 4-2 | 412.2 | 4.839 | WMD | 1.27 | 324.0238835 | 66.96091827 |
| 21 | 527.8 | 2.212 | WMG | 1.36 | 386.734902 | 174.8349466 |
| 6-1 | 577.6 | 2.439 | WMS | 1.46 | 396.3249718 | 162.4948634 |
| 25-1 | 302.4 | 1.595 | WRG | 1.43 | 211.9854545 | 132.9062411 |
| 25-2 | 328.7 | 1.65 | WRG | 1.50 | 219.3440385 | 132.9357809 |
| 26 | 373.9 | 2.874 | WRM | 1.46 | 256.554548 | 89.26741406 |
| 12-1 | 11.63 | 1.147 | WRS | 0.21 | 54.85295146 | 47.82297424 |
| 12-2 | 329.8 | 1.472 | WRS | 1.28 | 257.1698876 | 174.7078041 |
| 31-1 | 407.8 | 0.8996 | WRT | 1.38 | 296.5707186 | 329.6695404 |
| 31-2 | 411.3 | 0.9357 | WRT | 1.29 | 318.1680573 | 340.0321228 |
| 1-2 | 299.5 | 4.063 | WST | 1.38 | 217.8100299 | 53.60817867 |
| 16-2 | 280.1 | 3.952 | WTS | 1.34 | 208.3806738 | 52.72790329 |
| 15-1 | 389 | 2.952 | WVG | 1.13 | 344.8470803 | 116.8181166 |
| 15-2 | 409.6 | 3.041 | WVG | 1.12 | 366.4524494 | 120.5039294 |
| 20-1 | 11.46 | 1.81 | WVR | 0.20 | 56.80885714 | 31.38610892 |
| 20-2 | 422.6 | 2.274 | WVR | 0.96 | 438.6732479 | 192.9082005 |
| 8-1 | 376.4 | 3.957 | WYS | 1.22 | 308.3560202 | 77.92671727 |
| 8-2 | 362 | 3.693 | WYS | 1.19 | 304.2553633 | 82.38704666 |
| 50-1 | 220.8 | 1.794 | RYN | 1.30 | 169.4544076 | 94.45619152 |
| 51-1 | 240.9 | 2.473 | RYN | 1.30 | 184.8802844 | 74.75951652 |
| 52-1 | 297.3 | 2.096 | RYN | 1.45 | 205.4457183 | 98.0179954 |
| 54-2 | 70.96 | 2.005 | RRR | 1.38 | 51.60534132 | 25.738832485 |

FIG._13B

| MODEL | 236 | A | C | D | E | F | G | H | I | K | L | M | N | P | Q | R | S | T | V | W | Y | | |
|---|---|---|---|---|---|---|---|---|---|---|---|---|---|---|---|---|---|---|---|---|---|---|---|
| 124 | 119 | L | A | | | | F | | | | | L | | | | | | | | | | | 3 | |
| 126 | 121 | F | | | | | F | | | | | | | | | | | | | | | | 1 | |
| 162 | 151 | I | | | | | | | | I | | L | | | | | | | | V | | | 3 | |
| 187 | 176 | R | | | | | | | | | | | | | | | | | | | W | | 1 | |
| 188 | 177 | R | A | C | | E | | | | | K | L | M | | | Q | R | S | | | | | 9 | 1296 |
| 192 | 181 | R | | C | | | | | | | | | | N | | | | S | T | | | | 4 | |
| 215 | 204 | V | | | | | | | | I | | | | | | | | | | V | | | 2 | |
| 248 | 239 | L | | | | | | | | | | L | | | | | | | | | | | 1 | |
| 250 | 241 | F | | | | | F | | | | | | | | | | | | | | | | 1 | |
| 252 | 243 | I | | | | | | | | I | | | | | | | | | | V | | | 2 | |
Best Hits from In R1-W      Best Hits from In WXX
        WLS-4               WLG
        WAN                  WFQ-2
        WMS-5             WYS
        WRS-6             WIS-2
        WRT-1              WMG-5
        WST                  WMD
        WCT                  WRG
                                 WRM
                                 WVR-3
                                 WVG-7
                                 WTS
FIG._13C

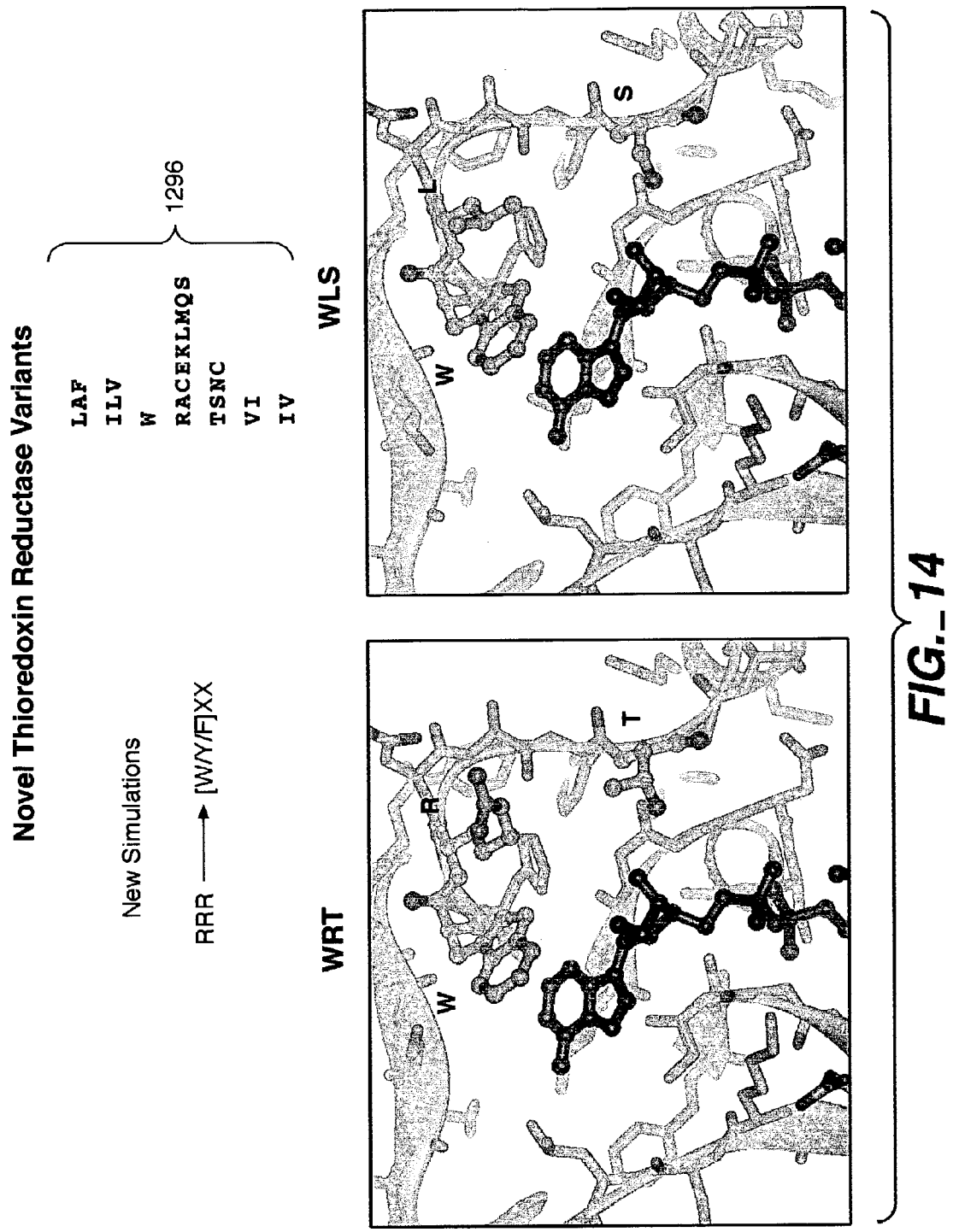
FIG._14

Diverse & Improved Catalytic Activities

✓ Equal to or Better than 50% of WT NADPH Activity, with NADH at 1.2 mM.
✓ Improved Catalytic Efficiency for the NADPH Activity also.
✓ 13-fold Better Kcat/Km and 2-fold Lower Km for NADH Compared to WT

| | Name | Experiment #1 (Average of Duplicates) | | | | Exp #2 (Avg of Quadruplicates) | | Kinetic Parameters | | | | |
|---|---|---|---|---|---|---|---|---|---|---|---|---|
| | | 0.6mM NADPH | 1.2mM NADPH | 0.6mM NADH | 1.2mM NADH | 1.2mM NADPH | 1.2mM NADH | KM | Kcat | Kcat/Km | P | H |
| R1-W Library Hits | WRT | 305.21 | 328.56 | 105.15 | 155.22 | 397.01 | 197.80 | 0.94 | 318.17 | 340.03 | | ▓ |
| | WLS | 19.35 | 30.90 | 74.51 | 127.79 | 41.62 | 155.55 | 2.17 | 413.04 | 190.69 | | |
| | WMS | 18.53 | 32.71 | 65.90 | 118.21 | 38.16 | 131.51 | 2.44 | 396.32 | 162.49 | | ▓ |
| | WRS | 327.73 | 318.02 | 61.73 | 98.49 | 375.26 | 123.29 | 1.47 | 257.17 | 174.71 | | |
| WXX Library Hits | WIS | 53.98 | 87.75 | 83.01 | 144.47 | 111.75 | 181.35 | 2.35 | 469.64 | 199.76 | | ▓ |
| | WFQ | 0.88 | 1.21 | 80.72 | 138.85 | 2.19 | 180.20 | 2.28 | 509.86 | 223.43 | | ▓ |
| | WVR | 475.26 | 569.27 | 72.03 | 129.98 | 731.53 | 157.60 | 2.27 | 438.67 | 192.91 | ▓ | ▓ |
| | WMG | 18.32 | 31.20 | 72.03 | 116.75 | 37.67 | 138.09 | 2.21 | 386.73 | 174.83 | | ▓ |
| | WVG | 59.72 | 107.59 | 49.83 | 92.51 | 134.90 | 110.87 | 3.04 | 366.45 | 120.50 | ▓ | |
| TR-2 | RYN | 8.16 | 14.27 | 34.91 | 57.12 | 16.92 | 66.01 | 1.79 | 169.45 | 94.46 | | |
| | RRR-WT | 206.76 | 217.81 | 10.09 | 17.18 | 291.75 | 19.00 | 2.01 | 51.61 | 25.74 | ▓ | |

▓ P: High NADH-Dependent Activity
▓ H: High NADPH-Dependent Activity

FIG._15

**The WVR variant coding sequence with S-tag at the N-terminus,
His-Tag at C-terminus (5238-26)**

```
1      tcgagcacca ccaccaccac cactgagatc cggctgctaa caaagcccga aaggaagctg
61     agttggctgc tgccaccgct gagcaataac tagcataacc ccttggggcc tctaaacggg
121    tcttgagggg ttttttgctg aaaggaggaa ctatatccgg attggcgaat gggacgcgcc
181    ctgtagcggc gcattaagcg cggcgggtgt ggtggttacg cgcagcgtga ccgctacact
241    tgccagcgcc ctagcgcccg ctcctttcgc tttcttccct tcctttctcg ccacgttcgc
301    cggctttccc cgtcaagctc taaatcgggg ctcccttta gggttccgat ttagtgcttt
361    acggcacctc gaccccaaaa aacttgatta gggtgatggt tcacgtagtg ggccatcgcc
421    ctgatagacg ttttttcgcc ctttgacgtt ggagtccacg ttctttaata gtggactctt
481    gttccaaact ggaacaacac tcaaccctat ctcggtctat tcttttgatt tataagggat
541    tttgccgatt tcggcctatt ggttaaaaaa tgagctgatt taacaaaaat ttaacgcgaa
601    ttttaacaaa atattaacgt ttacaatttc aggtggcact tttcggggaa atgtgcgcgg
661    aacccctatt tgtttattttt tctaaataca ttcaaatatg tatccgctca tgaattaatt
721    cttagaaaaa ctcatcgagc atcaaatgaa actgcaattt attcatatca ggattatcaa
781    taccatattt ttgaaaaagc cgtttctgta atgaaggaga aaactcaccg aggcagttcc
841    ataggatggc aagatcctgg tatcggtctg cgattccgac tcgtccaaca tcaatacaac
901    ctattaattt ccctcgtca aaataaggt tatcaagtga gaaatcacca tgagtgacga
961    ctgaatccgg tgagaatggc aaaagtttat gcatttcttt ccagacttgt tcaacaggcc
1021   agccattacg ctcgtcatca aaatcactcg catcaaccaa accgttattc attcgtgatt
1081   gcgcctgagc gagacgaaat acgcgatcgc tgttaaaagg acaattacaa acaggaatcg
1141   aatgcaaccg gcgcaggaac actgccagcg catcaacaat atttcacct gaatcaggat
1201   attcttctaa tacctggaat gctgttttcc cggggatcgc agtggtgagt aaccatgcat
1261   catcaggagt acggataaaa tgcttgatgg tcggaagagg cataaattcc gtcagccagt
1321   ttagtctgac catctcatct gtaacatcat tggcaacgct acctttgcca tgtttcagaa
1381   acaactctgg cgcatcgggc ttcccataca atcgatagat tgtcgcacct gattgcccga
1441   cattatcgcg agcccattta tacccatata aatcagcatc catgttggaa tttaatcgcg
1501   gcctagagca agacgtttcc cgttgaatat ggctcataac accccttgta ttactgttta
1561   tgtaagcaga cagttttatt gttcatgacc aaaatccctt aacgtgagtt ttcgttccac
1621   tgagcgtcag accccgtaga aagatcaaa ggatcttctt gagatccttt ttttctgcgc
1681   gtaatctgct gcttgcaaac aaaaaaacca ccgctaccag cggtggtttg tttgccggat
1741   caagagctac caactctttt tccgaaggta actggcttca gcagagcgca gataccaaat
1801   actgtccttc tagtgtagcc gtagttaggc caccacttca agaactctgt agcaccgcct
1861   acatacctcg ctctgctaat cctgttacca gtggctgctg ccagtggcga taagtcgtgt
1921   cttaccgggt tggactcaag acgatagtta ccggataagg cgcagcggtc gggctgaacg
1981   gggggttcgt gcacacagcc cagcttggag cgaacgacct acaccgaact gagataccta
2041   cagcgtgagc tatgagaaag cgccacgctt cccgaaggga aaaggcgga caggtatccg
2101   gtaagcggca gggtcggaac aggagagcgc acgagggagc ttccagggg aaacgcctgg
2161   tatctttata gtcctgtcgg gtttcgccac ctctgacttg agcgtcgatt tttgtgatgc
2221   tcgtcagggg ggcggagcct atggaaaaac gccagcaacg cggcctttttt acggttcctg
2281   gccttttgct ggccttttgc tcacatgttc tttcctgcgt tatccctga ttctgtggat
2341   aaccgtatta ccgcctttga gtgagctgat accgctcgcc gcagccgaac gaccgagcgc
2401   agcgagtcag tgagcgagga gcggaagag cgcctgatgc ggtattttct ccttacgcat
2461   ctgtgcggta tttcacaccg catatatggt gcactctcag tacaatctgc tctgatgccg
2521   catagttaag ccagtataca ctccgctatc gctacgtgac tgggtcatgg ctgcgccccg
2581   acacccgcca cacccgctg acgcgcctg acgggcttgt ctgctcccgg catccgctta
2641   cagacaagct gtgaccgtct ccgggagctg catgtgtcag aggttttcac cgtcatcacc
2701   gaaacgcgcg aggcagctgc ggtaaagctc atcagcgtgg tcgtgaagcg attcacagat
2761   gtctgcctgt tcatccgcgt ccagctcgtt gagtttctcc agaagcgtta atgtctggct
```

FIG._16A-1

```
2821 tctgataaag cgggccatgt taagggcggt ttttcctgt ttggtcactg atgcctccgt
2881 gtaaggggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt tacgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga acctgtcgt gccagctgca
3721 ttaatgaatc ggccaacgcg cggggagagg cggtttgcgt attgggcgcc agggtggttt
3781 tcttttcac cagtgagacg ggcaacagct gattgccctt caccgcctgg ccctgagaga
3841 gttgcagcaa gcggtccacg ctggtttgcc ccagcaggcg aaaatcctgt ttgatggtgg
3901 ttaacggcgg gatataacat gagctgtctt cggtatcgtc gtatcccact accgagatgt
3961 ccgcaccaac gcgcagcccg gactcggtaa tggcacgcat tgcgcccagc gccatctgat
4021 cgttggcaac cagcatcgca gtgggaacga tgccctcatt cagcatttgc atggtttgtt
4081 gaaaaccgga catggcactc cagtcgcctt cccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt ttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
4981 accatacccca cgccgaaaca agcgctcatg agcccgaagt ggcgagcccg atcttcccca
5041 tcggtgatgt cggcgatata ggcgccagca accgcacctg tggcgccggt gatgccggcc
5101 acgatgcgtc cggcgtagag gatcgagatc gatctcgatc ccgcgaaatt aatacgactc
5161 actataggg aattgtgagc ggataacaat tcccctctag aaataatttt gtttaacttt
5221 aagaaggaga tatacatatg aaagaaaccg ctgctgctaa attcgaacgc cagcacatgg
5281 acagcccaga tctgggtacc ctggtgccac gcggttccat ggctgatatc agatctaatg
5341 gtctcgaaac tcacaacaca aggctctgta tcgtaggaag tggcccagcg cacacacgg
5401 cggcgattta cgcagctagg gctgaactta aacctcttct cttcgaagga tggatggcta
5461 acgacatcgc tcccggtggt caactaacaa ccaccaccga cgtcgagaat ttccccggat
5521 ttccagaagg tattctcgga gtagagctca ctgacaaatt ccgtaaacaa tcggagcgat
5581 tcggtactac gatatttaca gagacggtga cgaaagtcga tttctcttcg aaaccgttta
5641 agctattcac agattccaag gccattctcg ctgacgctgt gattctcgct actggagctg
5701 tggctaagcg gcttagcttc gttggatctg gtgaaggttc tggaggtttc tggaaccgtg
5761 gaatctccgc atgcgctgtt tgcgacggag ctgctccgat attccgtaac aaacctcttg
```

```
5821  cggtgatcgg tggaggcgat tcagcaatgg aagaagcaaa ctttcttaca aaatatggat
5881  ccaaagtgta tataatccat tgggtggatg cttttcgggc gtctaagatt atgcagcagc
5941  gcgctttgtc taatcctaag attgatgtga tttggaactc gtctgttgtg gaagcttatg
6001  gagatggaga aagagatgtg cttggaggat tgaaagtgaa gaatgtggtt accggtgatg
6061  tttctgattt aaaagtttct ggattgttct ttgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg atggagtcga caagcttgcg gccgcac
```

FIG. _16A-3

The WMG variant coding sequence with S-tag at the N-terminus,
His-Tag at C-terminus (5238-26)

```
   1  tcgagcacca ccaccaccac cactgagatc cggctgctaa caaagcccga aaggaagctg
  61  agttggctgc tgccaccgct gagcaataac tagcataacc ccttggggcc tctaaacggg
 121  tcttgagggg ttttttgctg aaggaggaa ctatatccgg attggcgaat gggacgcgcc
 181  ctgtagcggc gcattaagcg cggcgggtgt ggtggttacg cgcagcgtga ccgctacact
 241  tgccagcgcc ctagcgcccg ctcctttcgc tttcttccct tcctttctcg ccacgttcgc
 301  cggctttccc cgtcaagctc taaatcgggg ctcccttta gggttccgat ttagtgcttt
 361  acggcacctc gaccccaaaa aacttgatta gggtgatggt tcacgtagtg ggccatcgcc
 421  ctgatagacg gttttcgcc ctttgacgtt ggagtccacg ttctttaata gtggactctt
 481  gttccaaact ggaacaacac tcaaccctat ctcggtctat tcttttgatt tataagggat
 541  tttgccgatt tcggcctatt ggttaaaaaa tgagctgatt taacaaaaat ttaacgcgaa
 601  ttttaacaaa atattaacgt ttacaatttc aggtggcact tttcggggaa atgtgcgcgg
 661  aacccctatt tgtttatttt tctaaataca ttcaaatatg tatccgctca tgaattaatt
 721  cttagaaaaa ctcatcgagc atcaaatgaa actgcaattt attcatatca ggattatcaa
 781  taccatattt tgaaaaagc cgtttctgta atgaaggaga aaactcaccg aggcagttcc
 841  ataggatggc aagatctgg tatcggtctg cgattccgac tcgtccaaca tcaatacaac
 901  ctattaattt cccctcgtca aaaataaggt tatcaagtga gaaatcacca tgagtgacga
 961  ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
1261  catcaggagt acggataaaa tgcttgatgg tcggaagagg cataaattcc gtcagccagt
1321  ttagtctgac catctcatct gtaacatcat ggcaacgct acctttgcca tgtttcagaa
1381  acaactctgg cgcatcgggc ttcccataca atcgatagat tgtcgcacct gattgcccga
1441  cattatcgcg agcccattta tacccatata aatcagcatc catgttggaa tttaatcgcg
1501  gcctagagca agacgtttcc cgttgaatat ggctcataac accccttgta ttactgttta
1561  tgtaagcaga cagtttatt gttcatgacc aaaatccctt aacgtgagtt ttcgttccac
1621  tgagcgtcag accccgtaga aagatcaaa ggatcttctt gagatccttt ttttctgcgc
1681  gtaatctgct gcttgcaaac aaaaaaacca ccgctaccag cggtggtttg tttgccggat
1741  caagagctac caactctttt tccgaaggta actggcttca gcagagcgca gataccaaat
1801  actgtccttc tagtgtagcc gtagttaggc caccacttca agaactctgt agcaccgcct
1861  acatacctcg ctctgctaat cctgttacca gtggctgctg ccagtggcga taagtcgtgt
1921  cttaccgggt tggactcaag acgatagtta ccggataagg cgcagcggtc gggctgaacg
```

FIG. _16B-1

```
1981 gggggttcgt gcacacagcc cagcttggag cgaacgacct acaccgaact gagataccta
2041 cagcgtgagc tatgagaaag cgccacgctt cccgaaggga gaaaggcgga caggtatccg
2101 gtaagcggca gggtcggaac aggagagcgc acgagggagc tccaggggg aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggccttttt acggttcctg
2281 gccttttgct ggccttttgc tcacatgttc tttcctgcgt tatcccctga ttctgtggat
2341 aaccgtatta ccgcctttga gtgagctgat accgctcgcc gcagccgaac gaccgagcgc
2401 agcgagtcag tgagcgagga agcggaagag cgcctgatgc ggtattttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgcccg
2581 acacccgcca acacccgctg acgcgccctg acggcttgt ctgctccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt tttttcctgt ttggtcactg atgcctccgt
2881 gtaagggga tttctgttca tggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt tacgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga aacctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt ttgatggtgg
3901 ttaacggcgg gatataacat gagctgtctt cggtatcgtc gtatcccact accgagatgt
3961 ccgcaccaac gcgcagcccg gactcggtaa tggcacgcat tgcgcccagc gccatctgat
4021 cgttggcaac cagcatcgca gtgggaacga tgccctcatt cagcatttgc atggtttgtt
4081 gaaaaccgga catggcactc cagtcgcctt cccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt ttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
```

FIG._16B-2

```
4981 accataccca cgccgaaaca agcgctcatg agcccgaagt ggcgagcccg atcttcccca
5041 tcggtgatgt cggcgatata ggcgccagca accgcacctg tggcgccggt gatgccggcc
5101 acgatgcgtc cggcgtagag gatcgagatc gatctcgatc ccgcgaaatt aatacgactc
5161 actataggqg aattgtgagc ggataacaat tcccctctag aaataatttt gtttaacttt
5221 aagaaggaga tatacatatg aaagaaaccg ctgctgctaa attcgaacgc cagcacatgg
5281 acagcccaga tctgggtacc ctggtgccac gcggttccat ggctgatatc agatctaatg
5341 gtctcgaaac tcacaacaca aggctctgta tcgtaggaag tggcccagcg gcacacacgg
5401 cggcgattta cgcagctagg gctgaactta aacctcttct cttcgaagga tggatggcta
5461 acgacatcgc tcccggtggt caactaacaa ccaccaccga cgtcgagaat ttccccggat
5521 ttccagaagg tattctcgga gtagagctca ctgacaaatt ccgtaaacaa tcggagcgat
5581 tcggtactac gatatttaca gagacggtga cgaaagtcga tttctcttcg aaaccgttta
5641 agctattcac agattccaag gccattctcg ctgacgctgt gattctcgct actggagctg
5701 tggctaagcg gcttagcttc gttggatctg gtgaaggttc tggaggtttc tggaaccgtg
5761 gaatctccgc atgcgctgtt tgcgacggag ctgctccgat attccgtaac aaacctcttg
5821 cggtgatcgg tggaggcgat tcagcaatgg aagaagcaaa ctttcttaca aaatatggat
5881 ccaaagtgta tataatccat tggatggatg cttttggtgc gtctaagatt atgcagcagc
5941 gcgctttgtc taatcctaag attgatgtga tttggaactc gtctgttgtg aagcttatg
6001 gagatggaga aagagatgtg cttggaggat tgaaagtgaa gaatgtggtt accggtgatg
6061 tttctgattt aaaagtttct ggattgttct ttgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg atggagtcga caagcttgcg gccgcac
```

FIG._16B-3

The WIS variant coding sequence with S-tag at the N-terminus,
His-Tag at C-terminus (5238-26)

```
   1 tcgagcacca ccaccaccac cactgagatc cggctgctaa caaagcccga aaggaagctg
  61 agttggctgc tgccaccgct gagcaataac tagcataacc ccttggggcc tctaaacggg
 121 tcttgagggg ttttttgctg aaaggaggaa ctatatccgg attggcgaat gggacgcgcc
 181 ctgtagcggc gcattaagcg cggcgggtgt ggtggttacg cgcagcgtga ccgctacact
 241 tgccagcgcc ctagcgcccg ctcctttcgc tttcttccct tcctttctcg ccacgttcgc
 301 cggctttccc cgtcaagctc taaatcgggg ctcccttta gggttccgat ttagtgcttt
 361 acggcacctc gaccccaaaa aacttgatta gggtgatggt tcacgtagtg ggccatcgcc
 421 ctgatagacg gtttttcgcc ctttgacgtt ggagtccacg ttctttaata gtggactctt
 481 gttccaaact ggaacaacac tcaaccctat ctcggtctat tcttttgatt tataagggat
 541 tttgccgatt tcggcctatt ggttaaaaaa tgagctgatt taacaaaaat ttaacgcgaa
 601 ttttaacaaa atattaacgt ttacaatttc aggtggcact tttcggggaa atgtgcgcgg
 661 aaccccctatt tgtttatttt tctaaataca ttcaaatatg tatccgctca tgaattaatt
 721 cttagaaaaa ctcatcgagc atcaaatgaa actgcaattt attcatatca ggattatcaa
 781 taccatattt ttgaaaaagc cgtttctgta atgaaggaga aaactcaccg aggcagttcc
 841 ataggatggc aagatcctgg tatcggtctg cgattccgac tcgtccaaca tcaatacaac
 901 ctattaattt cccctcgtca aaaataaggt tatcaagtga gaaatcacca tgagtgacga
 961 ctgaatccgg tgagaatggc aaaagtttat gcatttcttt ccagacttgt tcaacaggcc
1021 agccattacg ctcgtcatca aaatcactcg catcaaccaa accgttattc attcgtgatt
1081 gcgcctgagc gagacgaaat acgcgatcgc tgttaaaagg acaattacaa acaggaatcg
```

FIG._16C-1

```
1141 aatgcaaccg gcgcaggaac actgccagcg catcaacaat attttcacct gaatcaggat
1201 attcttctaa tacctggaat gctgttttcc cggggatcgc agtggtgagt aaccatgcat
1261 catcaggagt acggataaaa tgcttgatgg tcggaagagg cataaattcc gtcagccagt
1321 ttagtctgac catctcatct gtaacatcat tggcaacgct acctttgcca tgtttcagaa
1381 acaactctgg cgcatcgggc ttcccataca atcgatagat tgtcgcacct gattgcccga
1441 cattatcgcg agcccattta tacccatata aatcagcatc catgttggaa tttaatcgcg
1501 gcctagagca agacgtttcc cgttgaatat ggctcataac accccttgta ttactgttta
1561 tgtaagcaga cagttttatt gttcatgacc aaaatccctt aacgtgagtt ttcgttccac
1621 tgagcgtcag acccgtaga aaagatcaaa ggatcttctt gagatccttt ttttctgcgc
1681 gtaatctgct gcttgcaaac aaaaaaacca ccgctaccag cggtggtttg tttgccggat
1741 caagagctac caactctttt tccgaaggta actggcttca gcagagcgca gataccaaat
1801 actgtccttc tagtgtagcc gtagttaggc caccacttca agaactctgt agcaccgcct
1861 acatacctcg ctctgctaat cctgttacca gtggctgctg ccagtggcga taagtcgtgt
1921 cttaccgggt tggactcaag acgatagtta ccggataagg cgcagcggtc gggctgaacg
1981 gggggttcgt gcacacagcc cagcttggag cgaacgacct acaccgaact gagataccta
2041 cagcgtgagc tatgagaaag cgccacgctt cccgaaggga gaaaggcgga caggtatccg
2101 gtaagcggca gggtcggaac aggagagcgc acgagggagc ttccaggggg aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggccttttt acggttcctg
2281 gccttttgct ggccttttgc tcacatgttc tttcctgcgt tatcccctga ttctgtggat
2341 aaccgtatta ccgcctttga gtgagctgat accgctcgcc gcagccgaac gaccgagcgc
2401 agcgagtcag tgagcgagga agcggaagag cgcctgatgc ggtattttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgccccg
2581 acacccgcca cacccgctg acgcgccctg acgggcttgt ctgctcccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt tttttcctgt ttggtcactg atgcctccgt
2881 gtaaggggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt tacgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccgaagg agctgactgg
3601 gttgaaggct ctcaagggca tcggtcgaga tcccggtgcc taatgagtga gctaacttac
3661 attaattgcg ttgcgctcac tgcccgcttt ccagtcggga acctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt tgatggtgg
3901 ttaacggcgg gatataacat gagctgtctt cggtatcgtc gtatcccact accgagatgt
3961 ccgcaccaac gcgcagcccg gactcggtaa tggcacgcat tgcgcccagc gccatctgat
4021 cgttggcaac cagcatcgca gtgggaacga tgccctcatt cagcatttgc atggtttgtt
4081 gaaaaccgga catggcactc cagtcgcctt cccgttccgc tatcggctga atttgattgc
```

FIG._16C-2

```
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt tttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
4981 accatacccca cgccgaaaca agcgctcatg agcccgaagt ggcgagcccg atcttcccca
5041 tcggtgatgt cggcgatata ggcgccagca accgcacctg tggcgccggt gatgccggcc
5101 acgatgcgtc cggcgtagag gatcgagatc gatctcgatc ccgcgaaatt aatacgactc
5161 actataggga aattgtgagc ggataacaat tcccctctag aaataatttt gtttaacttt
5221 aagaaggaga tatacatatg aaagaaaccg ctgctgctaa attcgaacgc cagcacatgg
5281 acagcccaga tctgggtacc ctggtgccac gcggttccat ggctgatatc agatctaatg
5341 gtctcgaaac tcacaacaca aggctctgta tcgtaggaag tgcccagcg gcacacacgg
5401 cggcgattta cgcagctagg gctgaactta aacctcttct cttcgaagga tggatggcta
5461 acgacatcgc tcccggtggt caactaacaa ccaccaccga cgtcgagaat ttccccggat
5521 ttccagaagg tattctcgga gtagagctca ctgacaaatt ccgtaaacaa tcggagcgat
5581 tcggtactac gatatttaca gagacggtga cgaaagtcga tttctcttcg aaaccgttta
5641 agctattcac agattccaag gccattctcg ctgacgctgt gattctcgct actggagctg
5701 tggctaagcg gcttagcttc gttggatctg gtgaaggttc tggaggtttc tggaaccgtg
5761 gaatctccgc atgcgctgtt tgcgacggag ctgctccgat attccgtaac aaacctcttg
5821 cggtgatcgg tggaggcgat tcagcaatgg aagaagcaaa ctttcttaca aaatatggat
5881 ccaaagtgta tataatccat tggattgatg cttttctgc gtctaagatt atgcagcagc
5941 gcgctttgtc taatcctaag attgatgtga tttggaactc gtctgttgtg aagcttatg
6001 gagatggaga aagagatgtg cttggaggat tgaaagtgaa gaatgtggtt accggtgatg
6061 tttctgattt aaaagtttct ggattgttct ttgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg atggagtcga caagcttgcg gccgcac
```

FIG._16C-3

The WMS variant coding sequence with S-tag at the N-terminus,
His-Tag at C-terminus (5238-26)

```
1     tcgagcacca ccaccaccac cactgagatc cggctgctaa caaagcccga aaggaagctg
61    agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct tcctttctcg ccacgttcgc
301   cggctttccc cgtcaagctc taaatcgggg gctcccttta ggttccgat ttagtgcttt
361   acggcacctc gaccccaaaa aacttgatta gggtgatggt tcacgtagtg ggccatcgcc
421   ctgatagacg gtttttcgcc ctttgacgtt ggagtccacg ttctttaata gtggactctt
481   gttccaaact ggaacaacac tcaaccctat ctcggtctat tcttttgatt tataagggat
541   tttgccgatt tcggcctatt ggttaaaaaa tgagctgatt taacaaaaat ttaacgcgaa
601   ttttaacaaa atattaacgt ttacaatttc aggtggcact tttcggggaa atgtgcgcgg
661   aaccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt ttgaaaaagc cgtttctgta atgaaggaga aaactcaccg aggcagttcc
841   ataggatggc aagatcctgg tatcggtctg cgattccgac tcgtccaaca tcaatacaac
901   ctattaattt cccctcgtca aaaataaggt tatcaagtga gaaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
1261  catcaggagt acggataaaa tgcttgatgg tcggaagagg cataaattcc gtcagccagt
1321  ttagtctgac catctcatct gtaacatcat tggcaacgct acctttgcca tgtttcagaa
1381  acaactctgg cgcatcgggc ttcccataca atcgatagat tgtcgcacct gattgcccga
1441  cattatcgcg agcccattta tacccatata atcagcatc catgttggaa tttaatcgcg
1501  gcctagagca agacgtttcc cgttgaatat ggctcataac accccttgta ttactgttta
1561  tgtaagcaga cagttttatt gttcatgacc aaaatccctt aacgtgagtt ttcgttccac
1621  tgagcgtcag accccgtaga aagatcaaa ggatcttctt gagatccttt ttttctgcgc
1681  gtaatctgct gcttgcaaac aaaaaaacca ccgctaccag cggtggtttg tttgccggat
1741  caagagctac caactctttt tccgaaggta actggcttca gcagagcgca gataccaaat
1801  actgtccttc tagtgtagcc gtagttaggc caccacttca agaactctgt agcaccgcct
1861  acatacctcg ctctgctaat cctgttacca gtggctgctg ccagtggcga taagtcgtgt
1921  cttaccgggt tggactcaag acgatagtta ccggataagg cgcagcggtc gggctgaacg
1981  gggggttcgt gcacacagcc cagcttggag cgaacgacct acaccgaact gagatacct
2041  cagcgtgagc tatgagaaag cgccacgctt cccgaaggga aaggcggga caggtatccg
2101  gtaagcggca gggtcggaac aggagagcgc acgagggagc ttccaggggg aaacgcctgg
2161  tatctttata gtcctgtcgg gtttcgccac ctctgacttg agcgtcgatt tttgtgatgc
2221  tcgtcagggg gcggagcct atggaaaaac gccagcaacg cggccttttt acggttcctg
2281  gccttttgct ggccttttgc tcacatgttc tttcctgcgt tatccctga ttctgtggat
2341  aaccgtatta ccgcctttga gtgagctgat accgctcgcc gcagccgaac gaccgagcgc
2401  agcgagtcag tgagcgagga agcggaagag cgcctgatgc ggtatttct ccttacgcat
2461  ctgtgcggta tttcacaccg catatatggt gcactctcag tacaatctgc tctgatgccg
2521  catagttaag ccagtataca ctccgctatc gctacgtgac tgggtcatgg ctgcgccccg
2581  acaccgcca acaccgctg acgcgccctg acgggcttgt ctgctcccgg catccgctta
2641  cagacaagct gtgaccgtct ccgggagctg catgtgtcag aggttttcac cgtcatcacc
2701  gaaacgcgcg aggcagctgc ggtaaagctc atcagcgtgg tcgtgaagcg attcacagat
2761  gtctgcctgt tcatccgcgt ccagctcgtt gagtttctcc agaagcgtta atgtctggct
```

FIG._16D-1

```
2821  tctgataaag cgggccatgt taagggcggt ttttcctgt ttggtcactg atgcctccgt
2881  gtaagggga tttctgttca tggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa aatcactcag ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagccgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga aacctgtcgt gccagctgca
3721  ttaatgaatc ggccaacgcg cggggagagg cggtttgcgt attgggcgcc agggtggttt
3781  ttcttttcac cagtgagacg ggcaacagct gattgcccctt caccgcctgg ccctgagaga
3841  gttgcagcaa gcggtccacg ctggtttgcc ccagcaggcg aaaatcctgt ttgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaccgga catggcactc cagtcgcctt cccgttccgc tatcggctga atttgattgc
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt tttcccgcgt tttcgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctcccctta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
4981  accatacccca cgccgaaaca agcgctcatg agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actataggg aattgtgagc ggataacaat tcccctctag aaataattt gtttaactt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggtctgta tcgtaggaag tgcccagcg cacacacgg
5401  cggcgattta cgcagctagg gctgaactta aacctcttct cttcgaagga tggatggcta
5461  acgacatcgc tcccggtggt caactaacaa ccaccaccga cgtcgagaat ttccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
```

FIG._16D-2

```
5821  cggtgatcgg tggaggcgat tcagcaatgg aagaagcaaa ctttcttaca aaatatggat
5881  ccaaagtgta tataatccat tggatggatg cttttcggc gtctaagatt atgcagcagc
5941  gcgctttgtc taatcctaag attgatgtga tttggaactc gtctgttgtg aagcttatg
6001  gagatggaga aagagatgtg cttggaggat tgaaagtgaa gaatgtggtt accggtgatg
6061  tttctgattt aaaagtttct ggattgttct ttgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg atggagtcga caagcttgcg gccgcac
```

FIG._16D-3

The WLS variant coding sequence with S-tag at the N-terminus,
His-Tag at C-terminus (5238-26)

```
1     tcgagcacca ccaccaccac cactgagatc cggctgctaa caaagcccga aaggaagctg
6     1agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct tcctttctcg ccacgttcgc
301   cggctttccc cgtcaagctc taaatcgggg gctcccttta gggttccgat ttagtgcttt
361   acggcacctc gaccccaaaa aacttgatta gggtgatggt tcacgtagtg gccatcgcc
421   ctgatagacg ttttttcgcc ctttgacgtt ggagtccacg ttctttaata gtggactctt
481   gttccaaact ggaacaacac tcaaccctat ctcggtctat tcttttgatt tataagggat
541   tttgccgatt tcggcctatt ggttaaaaaa tgagctgatt taacaaaaat ttaacgcgaa
601   ttttaacaaa atattaacgt ttacaatttc aggtggcact tttcggggaa atgtgcgcgg
661   aacccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt ttgaaaaagc cgtttctgta atgaaggaga aaactcaccg aggcagttcc
841   ataggatggc aagatcctgg tatcggtctg cgattccgac tcgtccaaca tcaatacaac
901   ctattaattt cccctcgtca aaaataaggt tatcaagtga gaaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
1261  catcaggagt acggataaaa tgcttgatgg tcggaagagg cataaattcc gtcagccagt
1321  ttagtctgac catctcatct gtaacatcat tggcaacgct acctttgcca tgtttcagaa
1381  acaactctgg cgcatcgggc ttcccataca atcgatagat tgtcgcacct gattgcccga
1441  cattatcgcg agcccattta tacccatata atcagcatc catgttggaa tttaatgcgcg
1501  gcctagagca agacgtttcc cgttgaatat ggctcataac accccttgta ttactgttta
1561  tgtaagcaga cagtttattt gttcatgacc aaaatccctt aacgtgagtt ttcgttccac
1621  tgagcgtcag accccgtaga aagatcaaa ggatcttctt gagatccttt ttttctgcgc
1681  gtaatctgct gcttgcaaac aaaaaaacca ccgctaccag cggtggtttg tttgccggat
1741  caagagctac caactctttt tccgaaggta actggcttca gcagagcgca gataccaaat
1801  actgtccttc tagtgtagcc gtagttaggc caccacttca agaactctgt agcaccgcct
1861  acatacctcg ctctgctaat cctgttacca gtggctgctg ccagtggcga taagtcgtgt
1921  cttaccgggt tggactcaag acgatagtta ccggataagg cgcagcggtc gggctgaacg
```

FIG._16E-1

```
1981  ggggttcgt gcacacagcc cagcttggag cgaacgacct acaccgaact gagatacctca
2041  cagcgtgagc tatgagaaag cgccacgctt cccgaaggga gaaggcgga caggtatccg
2101  gtaagcggca gggtcggaac aggagagcgc acgagggagc ttccagggg aaacgcctgg
2161  tatctttata gtcctgtcgg gtttcgccac ctctgacttg agcgtcgatt tttgtgatgc
2221  tcgtcagggg ggcggagcct atggaaaaac gccagcaacg cggcctttt acggttcctg
2281  gcctttgct ggccttttgc tcacatgttc tttcctgcgt tatccctga ttctgtggat
2341  aaccgtatta ccgcctttga gtgagctgat accgctcgcc gcagccgaac gaccgagcgc
2401  agcgagtcag tgagcgagga agcggaagag cgcctgatgc ggtatttct ccttacgcat
2461  ctgtgcggta tttcacaccg catatatggt gcactctcag tacaatctgc tctgatgccg
2521  catagttaag ccagtataca ctccgctatc gctacgtgac tgggtcatgg ctgcgcccg
2581  acacccgcca cacccgctg acgcgcctg acgggcttgt ctgctccgg catccgctta
2641  cagacaagct gtgaccgtct ccgggagctg catgtgtcag aggttttcac cgtcatcacc
2701  gaaacgcgcg aggcagctgc ggtaaagctc atcagcgtgg tcgtgaagcg attcacagat
2761  gtctgcctgt tcatccgcgt ccagctcgtt gagtttctcc agaagcgtta atgtctggct
2821  tctgataaag cgggccatgt taagggcggt ttttcctgt ttggtcactg atgcctccgt
2881  gtaaggggga tttctgttca tgggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa aatcactcag ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagccgggt
3301  cctcaacgac aggagcacga tcatgcgcac ccgtgggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga aacctgtcgt gccagctgca
3721  ttaatgaatc ggccaacgcg cggggagagg cggtttgcgt attgggcgcc agggtggttt
3781  ttcttttcac cagtgagacg ggcaacagct gattgccctt caccgcctgg cctgagaga
3841  gttgcagcaa gcggtccacg ctggtttgcc ccagcaggcg aaaatcctgt tgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaccgga catggcactc cagtcgcctt cccgttccgc tatcggctga atttgattgc
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg tgggaatgt
4621  aattcagctc cgccatcgcc gcttccactt tttcccgcgt tttcgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctccctta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
```

FIG._16E-2

```
4981 accatacccca cgccgaaaca agcgctcatg agcccgaagt ggcgagcccg atcttcccca
5041 tcggtgatgt cggcgatata ggcgccagca accgcacctg tggcgccggt gatgccggcc
5101 acgatgcgtc cggcgtagag gatcgagatc gatctcgatc ccgcgaaatt aatacgactc
5161 actatagggg aattgtgagc ggataacaat tcccctctag aaataatttt gtttaacttt
5221 aagaaggaga tatacatatg aaagaaaccg ctgctgctaa attcgaacgc cagcacatgg
5281 acagcccaga tctgggtacc ctggtgccac gcggttccat ggctgatatc agatctaatg
5341 gtctcgaaac tcacaacaca aggctctgta tcgtaggaag tggcccagcg gcacacacgg
5401 cggcgattta cgcagctagg gctgaactta aacctcttct cttcgaagga tggatggcta
5461 acgacatcgc tcccggtggt caactaacaa ccaccaccga cgtcgagaat tcccccggat
5521 ttccagaagg tattctcgga gtagagctca ctgacaaatt ccgtaaacaa tcggagcgat
5581 tcggtactac gatatttaca gagacggtga cgaaagtcga tttctcttcg aaaccgttta
5641 agctattcac agattccaag gccattctcg ctgacgctgt gattctcgct actggagctg
5701 tggctaagcg gcttagcttc gttggatctg tgaaggttc tggaggtttc tggaaccgtg
5761 gaatctccgc atgcgctgtt tgcgacggag ctgctccgat attccgtaac aaacctcttg
5821 cggtgatcgg tggaggcgat tcagcaatgg aagaagcaaa ctttcttaca aaatatggat
5881 ccaaagtgta tataatccat tggttggatg ctttttctgc gtctaagatt atgcagcagc
5941 gcgctttgtc taatcctaag attgatgtga tttggaactc gtctgttgtg aagcttatg
6001 gagatggaga aagagatgtg cttggaggat tgaaagtgaa gaatgtggtt accggtgatg
6061 tttctgattt aaaagtttct ggattgttct ttgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg atggagtcga caagcttgcg gccgcac
```

FIG._16E-3

The WRT variant coding sequence with S-tag at the N-terminus,
His-Tag at C-terminus (5238-26)

```
1    tcgagcacca ccaccaccac cactgagatc cggctgctaa caaagcccga aaggaagctg
61   agttggctgc tgccaccgct gagcaataac tagcataacc ccttggggcc tctaaacggg
121  tcttgagggg ttttttgctg aaaggaggaa ctatatccgg attggcgaat gggacgcgcc
181  ctgtagcggc gcattaagcg cggcgggtgt ggtggttacg cgcagcgtga ccgctacact
241  tgccagcgcc ctagcgcccg ctcctttcgc tttcttccct tcctttctcg ccacgttcgc
301  cggctttccc cgtcaagctc taaatcgggg ctccctttta gggttccgat ttagtgcttt
361  acggcacctc gaccccaaaa aacttgatta gggtgatggt tcacgtagtg gccatcgcc
421  ctgatagacg gtttttcgcc ctttgacgtt ggagtccacg ttctttaata gtggactctt
481  gttccaaact ggaacaacac tcaaccctat ctcggtctat tcttttgatt tataagggat
541  tttgccgatt tcggcctatt ggttaaaaaa tgagctgatt taacaaaaat ttaacgcgaa
601  ttttaacaaa atattaacgt ttacaatttc aggtggcact tttcggggaa atgtgcgcgg
661  aaccccctatt tgtttatttt tctaaataca ttcaaatatg tatccgctca tgaattaatt
721  cttagaaaaa ctcatcgagc atcaaatgaa actgcaattt attcatatca ggattatcaa
781  taccatattt tgaaaaagc cgtttctgta atgaaggaga aaactcaccg aggcagttcc
841  ataggatggc aagatcctgg tatcggtctg cgattccgac tcgtccaaca tcaatacaac
901  ctattaattt cccctcgtca aaaataaggt tatcaagtga gaaatcacca tgagtgacga
961  ctgaatccgg tgagaatggc aaaagtttat gcatttcttt ccagacttgt tcaacaggcc
1021 agccattacg ctcgtcatca aaatcactcg catcaaccaa accgttattc attcgtgatt
1081 gcgcctgagc gagacgaaat acgcgatcgc tgttaaaagg acaattacaa acaggaatcg
```

FIG._16F-1

```
1141  aatgcaaccg gcgcaggaac actgccagcg catcaacaat attttcacct gaatcaggat
1201  attcttctaa tacctggaat gctgttttcc cggggatcgc agtggtgagt aaccatgcat
1261  catcaggagt acggataaaa tgcttgatgg tcggaagagg cataaattcc gtcagccagt
1321  ttagtctgac catctcatct gtaacatcat tggcaacgct acctttgcca tgtttcagaa
1381  acaactctgg cgcatcgggc ttcccataca atcgatagat tgtcgcacct gattgcccga
1441  cattatcgcg agcccattta tacccatata aatcagcatc catgttggaa tttaatcgcg
1501  gcctagagca agacgtttcc cgttgaatat ggctcataac accccttgta ttactgttta
1561  tgtaagcaga cagttttatt gttcatgacc aaaatccctt aacgtgagtt ttcgttccac
1621  tgagcgtcag accccgtaga aaagatcaaa ggatcttctt gagatccttt ttttctgcgc
1681  gtaatctgct gcttgcaaac aaaaaaacca ccgctaccag cggtggtttg tttgccggat
1741  caagagctac caactctttt tccgaaggta actggcttca gcagagcgca gataccaaat
1801  actgtccttc tagtgtagcc gtagttaggc caccacttca agaactctgt agcaccgcct
1861  acatacctcg ctctgctaat cctgttacca gtggctgctg ccagtggcga taagtcgtgt
1921  cttaccgggt tggactcaag acgatagtta ccggataagg cgcagcggtc gggctgaacg
1981  gggggttcgt gcacacagcc cagcttggag cgaacgacct acaccgaact gagatacccta
2041  cagcgtgagc tatgagaaag cgccacgctt cccgaaggga aaaggcgga caggtatccg
2101  gtaagcggca gggtcggaac aggagagcgc acgagggagc ttccaggggg aaacgcctgg
2161  tatctttata gtcctgtcgg gtttcgccac ctctgacttg agcgtcgatt tttgtgatgc
2221  tcgtcagggg gcggagcct atggaaaaac gccagcaacg cggcctttt acggttcctg
2281  gccttttgct ggccttttgc tcacatgttc tttcctgcgt tatcccctga ttctgtggat
2341  aaccgtatta ccgcctttga gtgagctgat accgctcgcc gcagccgaac gaccgagcgc
2401  agcgagtcag tgagcgagga agcggaagag cgcctgatgc ggtatttct ccttacgcat
2461  ctgtgcggta tttcacaccg catatatggt gcactctcag tacaatctgc tctgatgccg
2521  catagttaag ccagtataca ctccgctatc gctacgtgac tgggtcatgg ctgcgccccg
2581  acacccgcca cacccgctg acgcgcctg acggcttgt ctgctccgg catccgctta
2641  cagacaagct gtgaccgtct ccgggagctg catgtgtcag aggttttcac cgtcatcacc
2701  gaaacgcgcg aggcagctgc ggtaaagctc atcagcgtgg tcgtgaagcg attcacagat
2761  gtctgcctgt tcatccgcgt ccagctcgtt gagtttctcc agaagcgtta atgtctggct
2821  tctgataaag cgggccatgt taagggcggt ttttcctgt ttggtcactg atgcctccgt
2881  gtaaggggga tttctgttca tgggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa aatcactcag ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagcgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga acctgtcgt gccagctgca
3721  ttaatgaatc ggccaacgcg cggggagagg cggtttgcgt attgggcgcc agggtggttt
3781  ttcttttcac cagtgagacg ggcaacagct gattgcccct caccgctgg ccctgagaga
3841  gttgcagcaa gcggtccacg ctggtttgcc ccagcaggcg aaaatcctgt ttgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaaccgga catggcactc cagtcgcctt cccgttccgc tatcggctga atttgattgc
```

FIG._16F-2

```
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt tttcccgcgt tttcgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctccctta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
4981  accatcccca cgccgaaaca agcgctcatg agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actataaggg aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tggcccagcg gcacacacgg
5401  cggcgattta cgcagctagg gctgaactta aacctcttct cttcgaagga tggatggcta
5461  acgacatcgc tcccggtggt caactaacaa ccaccaccga cgtcgagaat ttccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacgag ctgctccgat attccgtaac aaacctcttg
5821  cggtgatcgg tggaggcgat tcagcaatgg aagaagcaaa ctttcttaca aaatatggat
5881  ccaaagtgta tataatccat tggcgtgatg ctttactgc gtctaagatt atgcagcagc
5941  gcgctttgtc taatcctaag attgatgtga tttggaactc gtctgttgtg gaagcttatg
6001  gagatggaga aagagatgtg cttggaggat tgaaagtgaa gaatgtggtt accggtgatg
6061  tttctgattt aaaagtttct ggattgttct ttgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg atggagtcga caagcttgcg gccgcac
```

FIG._16F-3

The RYN variant coding sequence with S-tag at the N-terminus,
His-Tag at C-terminus (5238-26)

```
   1   tcgagcacca ccaccaccac cactgagatc cggctgctaa caaagcccga aaggaagctg
  61   agttggctgc tgccaccgct gagcaataac tagcataacc ccttggggcc tctaaacggg
 121   tcttgagggg ttttttgctg aaaggaggaa ctatatccgg attggcgaat gggacgcgcc
 181   ctgtagcggc gcattaagcg cggcgggtgt ggtggttacg cgcagcgtga ccgctacact
 241   tgccagcgcc ctagcgcccg ctcctttcgc tttcttccct tcctttctcg ccacgttcgc
 301   cggctttccc cgtcaagctc taaatcgggg gctcccttta gggttccgat ttagtgcttt
 361   acggcacctc gaccccaaaa aacttgatta gggtgatggt tcacgtagtg gccatcgcc
 421   ctgatagacg gttttttcgcc ctttgacgtt ggagtccacg ttctttaata gtggactctt
 481   gttccaaact ggaacaacac tcaaccctat ctcggtctat tcttttgatt tataagggat
 541   tttgccgatt tcggcctatt ggttaaaaaa tgagctgatt taacaaaaat ttaacgcgaa
 601   ttttaacaaa atattaacgt ttacaatttc aggtggcact tttcggggaa atgtgcgcgg
 661   aaccccctatt tgtttatttt tctaaataca ttcaaatatg tatccgctca tgaattaatt
 721   cttagaaaaa ctcatcgagc atcaaatgaa actgcaattt attcatatca ggattatcaa
 781   taccatattt ttgaaaaagc cgtttctgta atgaaggaga aaactcaccg aggcagttcc
 841   ataggatggc aagatcctgg tatcggtctg cgattccgac tcgtccaaca tcaatacaac
 901   ctattaattt ccctcgtca aaaataaggt tatcaagtga gaaatcacca tgagtgacga
 961   ctgaatccgg tgagaatggc aaaagtttat gcatttcttt ccagacttgt tcaacaggcc
1021   agccattacg ctcgtcatca aaatcactcg catcaaccaa accgttattc attcgtgatt
1081   gcgcctgagc gagacgaaat acgcgatcgc tgttaaaagg acaattacaa acaggaatcg
1141   aatgcaaccg gcgcaggaac actgccagcg catcaacaat attttcacct gaatcaggat
1201   attcttctaa tacctggaat gctgttttcc cggggatcgc agtggtgagt aaccatgcat
1261   catcaggagt acggataaaa tgcttgatgg tcggaagagg cataaattcc gtcagccagt
1321   ttagtctgac catctcatct gtaacatcat tggcaacgct acctttgcca tgtttcagaa
1381   acaactctgg cgcatcgggc ttcccataca atcgatagat tgtcgcacct gattgcccga
1441   cattatcgcg agcccattta tacccatata aatcagcatc catgttggaa tttaatcgcg
1501   gcctagagca agacgtttcc cgttgaatat ggctcataac accccttgta ttactgttta
1561   tgtaagcaga cagtttttatt gttcatgacc aaaatccctt aacgtgagtt ttcgttccac
1621   tgagcgtcag accccgtaga aaagatcaaa ggatcttctt gagatccttt ttttctgcgc
1681   gtaatctgct gcttgcaaac aaaaaaacca ccgctaccag cggtggtttg tttgccggat
1741   caagagctac caactctttt tccgaaggta actggcttca gcagagcgca gataccaaat
1801   actgtccttc tagtgtagcc gtagttaggc caccacttca agaactctgt agcaccgcct
1861   acatacctcg ctctgctaat cctgttacca gtggctgctg ccagtggcga taagtcgtgt
1921   cttaccgggt tggactcaag acgatagtta ccggataagg cgcagcggtc gggctgaacg
1981   gggggttcgt gcacacagcc cagcttggag cgaacgacct acaccgaact gagatacca
2041   cagcgtgagc tatgagaaag cgccacgctt cccgaaggga gaaaggcgga caggtatccg
2101   gtaagcggca gggtcggaac aggagagcgc acgagggagc ttccaggggg aaacgcctgg
2161   tatctttata gtcctgtcgg gtttcgccac ctctgacttg agcgtcgatt tttgtgatgc
2221   tcgtcagggg gcggagcct atggaaaaac gccagcaacg cggccttttt acggttcctg
2281   gccttttgct ggccttttgc tcacatgttc tttcctgcgt tatccctga ttctgtggat
2341   aaccgtatta ccgcctttga gtgagctgat accgctcgcc gcagccgaac gaccgagcgc
2401   agcgagtcag tgagcgagga gcggaagag cgcctgatgc ggtatttct ccttacgcat
2461   ctgtgcggta tttcacaccg catatatggt gcactctcag tacaatctgc tctgatgccg
2521   catagttaag ccagtataca ctccgctatc gctacgtgac tgggtcatgg ctgcgccccg
2581   acacccgcca cacccgctg acgcgccctg acgggcttgt ctgctcccgg catccgctta
2641   cagacaagct gtgaccgtct ccgggagctg catgtgtcag aggttttcac cgtcatcacc
2701   gaaacgcgcg aggcagctgc ggtaaagctc atcagcgtgg tcgtgaagcg attcacagat
2761   gtctgcctgt tcatccgcgt ccagctcgtt gagtttctcc agaagcgtta atgtctggct
```

FIG._16G-1

```
2821  tctgataaag cggggccatgt taagggcggt tttttcctgt ttggtcactg atgcctccgt
2881  gtaagggga tttctgttca tggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa atcactcag ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagccgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga acctgtcgt gccagctgca
3721  ttaatgaatc ggccaacgcg cggggagagg cggtttgcgt attgggcgcc agggtggttt
3781  ttcttttcac cagtgagacg ggcaacagct gattgccctt caccgcctgg ccctgagaga
3841  gttgcagcaa gcggtccacg ctggtttgcc ccagcaggcg aaaatcctgt ttgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaaccgga catggcactc cagtcgcctt cccgttccgc tatcggctga atttgattgc
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt tttccgcgt tttcgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctccctta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
4981  accataccca cgccgaaaca agcgctcatg agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actataggg aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tggcccagcg gcacacacgg
5401  cggcgattta cgcagctagg gctgaactta aacctcttct cttcgaagga tggatggcta
5461  acgacatcgc tcccggtggt caactaacaa ccaccaccga cgtcgagaat ttccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
```

```
5821  cggtgatcgg  tggaggcgat  tcagcaatgg  aagaagcaaa  ctttcttaca  aaatatggat
5881  ccaaagtgta  tataatccat  cgctacgatg  cttttaacgc  gtctaagatt  atgcagcagc
5941  gcgctttgtc  taatcctaag  attgatgtga  tttggaactc  gtctgttgtg  gaagcttatg
6001  gagatggaga  aagagatgtg  cttggaggat  tgaaagtgaa  gaatgtggtt  accggtgatg
6061  tttctgattt  aaaagtttct  ggattgttct  tgctattgg   tcatgagcca  gctaccaagt
6121  ttttggatgg  tggtgttgag  ttagattcgg  atggttatgt  tgtcacgaag  cctggtacta
6181  cacagactag  cgttcccgga  gttttcgctg  cgggtgatgt  tcaggataag  aagtataggc
6241  aagccatcac  tgctgcagga  actgggtgca  tggcagcttt  ggatgcagag  cattacttac
6301  aagagattgg  atctcagcaa  ggtaagagtg  atggagtcga  caagcttgcg  gccgcac
```

FIG. _16G-3

The RFN-A variant coding sequence with S-tag at the N-terminus,
His-Tag at C-terminus (5238-26)

```
1     tcgagcacca  ccaccaccac  cactgagatc  cggctgctaa  caaagcccga  aaggaagctg
61    agttggctgc  tgccaccgct  gagcaataac  tagcataacc  ccttggggcc  tctaaacggg
121   tcttgagggg  ttttttgctg  aaaggaggaa  ctatatccgg  attggcgaat  gggacgcgcc
181   ctgtagcggc  gcattaagcg  cggcgggtgt  ggtggttacg  cgcagcgtga  ccgctacact
241   tgccagcgcc  ctagcgcccg  ctcctttcgc  tttcttccct  tcctttctcg  ccacgttcgc
301   cggctttccc  cgtcaagctc  taaatcgggg  gctcccttta  gggttccgat  ttagtgcttt
361   acggcacctc  gaccccaaaa  aacttgatta  gggtgatggt  tcacgtagtg  gccatcgcc
421   ctgatagacg  gttttcgcc   ctttgacgtt  ggagtccacg  ttctttaata  gtggactctt
481   gttccaaact  ggaacaacac  tcaaccctat  ctcggtctat  tctttgatt   tataagggat
541   tttgccgatt  tcggcctatt  ggttaaaaaa  tgagctgatt  taacaaaaat  ttaacgcgaa
601   ttttaacaaa  atattaacgt  ttacaatttc  aggtggcact  tttcggggaa  atgtgcgcgg
661   aaccctatt   tgtttatttt  tctaaataca  ttcaaatatg  tatccgctca  tgaattaatt
721   cttagaaaaa  ctcatcgagc  atcaaatgaa  actgcaattt  attcatatca  ggattatcaa
781   taccatattt  tgaaaaagc   cgtttctgta  atgaaggaga  aaactcaccg  aggcagttcc
841   ataggatggc  aagatcctgg  tatcggtctg  cgattccgac  tcgtccaaca  tcaatacaac
901   ctattaattt  ccctcgtca   aaaataaggt  tatcaagtga  gaaatcacca  tgagtgacga
961   ctgaatccgg  tgagaatggc  aaaagtttat  gcatttcttt  ccagacttgt  tcaacaggcc
1021  agccattacg  ctcgtcatca  aaatcactcg  catcaaccaa  accgttattc  attcgtgatt
1081  gcgcctgagc  gagacgaaat  acgcgatcgc  tgttaaaagg  acaattacaa  acaggaatcg
1141  aatgcaaccg  gcgcaggaac  actgccagcg  catcaacaat  attttcacct  gaatcaggat
1201  attcttctaa  tacctggaat  gctgttttcc  cggggatcgc  agtggtgagt  aaccatgcat
1261  catcaggagt  acggataaaa  tgcttgatgg  tcggaagagg  cataaattcc  gtcagccagt
1321  ttagtctgac  catctcatct  gtaacatcat  tggcaacgct  acctttgcca  tgtttcagaa
1381  acaactctgg  cgcatcgggc  ttcccataca  atcgatagat  tgtcgcacct  gattgcccga
1441  cattatcgcg  agcccattta  tacccatata  aatcagcatc  catgttggaa  tttaatcgcg
1501  gcctagagca  agacgtttcc  cgttgaatat  ggctcataac  accccttgta  ttactgttta
1561  tgtaagcaga  cagttttatt  gttcatgacc  aaaatccctt  aacgtgagtt  ttcgttccac
1621  tgagcgtcag  accccgtaga  aagatcaaa   ggatcttctt  gagatccttt  ttttctgcgc
1681  gtaatctgct  gcttgcaaac  aaaaaaacca  ccgctaccag  cggtggtttg  tttgccggat
1741  caagagctac  caactctttt  tccgaaggta  actggcttca  gcagagcgca  gataccaaat
1801  actgtccttc  tagtgtagcc  gtagttaggc  caccacttca  agaactctgt  agcaccgcct
1861  acatacctcg  ctctgctaat  cctgttacca  gtggctgctg  ccagtggcga  taagtcgtgt
1921  cttaccgggt  tggactcaag  acgatagtta  ccggataagg  cgcagcggtc  gggctgaacg
```

FIG. _16H-1

```
1981 gggggttcgt gcacacagcc cagcttggag cgaacgacct acaccgaact gagataccta
2041 cagcgtgagc tatgagaaag cgccacgctt cccgaaggga gaaaggcgga caggtatccg
2101 gtaagcggca gggtcggaac aggagagcgc acgagggagc ttccaggggg aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggccttttt acggttcctg
2281 gccttttgct ggccttttgc tcacatgttc tttcctgcgt tatcccctga ttctgtggat
2341 aaccgtatta ccgcctttga gtgagctgat accgctcgcc gcagccgaac gaccgagcgc
2401 agcgagtcag tgagcgagga gcggaagag cgcctgatgc ggtattttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgcccg
2581 acacccgcca acacccgctg acgcgcctg acgggcttgt ctgctcccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt ttttcctgt tggtcactg atgcctccgt
2881 gtaaggggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt tacgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga aacctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt tgatggtgg
3901 ttaacggcgg gatataacat gagctgtctt cggtatcgtc gtatcccact accgagatgt
3961 ccgcaccaac gcgcagcccg gactcggtaa tggcacgcat tgcgcccagc gccatctgat
4021 cgttggcaac cagcatcgca gtgggaacga tgccctcatt cagcatttgc atggtttgtt
4081 gaaaaccgga catggcactc cagtcgcctt cccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccc cagttgttg tgccacgcgg ttgggaatgt
4621 aattcagctc cgccatcgcc gcttccactt ttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga gccgttgag caccgccgcc
4921 gcaaggaatg gtgcatgcaa ggagatggcg cccaacagtc cccggccac ggggcctgcc
```

```
4981  accatacccc cgccgaaaca agcgctcatg agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actatagggg aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tggcccagcg gcacacacgg
5401  cggcgattta cgcagctagg gctgaactta aacctcttct cttcgaagga tggatggcta
5461  acgacatcgc tcccggtggt caactaacaa ccaccaccga cgtcgagaat tccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
5821  cggtgatcgg tggaggcgat tcagcaatgg aagaagcaaa ctttcttaca aaatatggat
5881  ccaaagtgta tataatccat cgctttgatg cttttaacgc ggctaagatt atgcagcagc
5941  gcgctttgtc taatcctaag attgatgtga tttggaactc gtctgttgtg gaagcttatg
6001  gagatggaga aagagatgtg cttggaggat tgaaagtgaa gaatgtggtt accggtgatg
6061  tttctgattt aaaagtttct ggattgttct ttgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg atggagtcga caagcttgcg gccgcac
```

FIG._16H-3

The RFN variant coding sequence with S-tag at the N-terminus,
His-Tag at C-terminus (5238-26)

```
1     tcgagcacca ccaccaccac cactgagatc cggctgctaa caaagcccga aaggaagctg
61    agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct tcctttctcg ccacgttcgc
301   cggctttccc cgtcaagctc taaatcgggg gctcccttta gggttccgat ttagtgcttt
361   acggcacctc gaccccaaaa aacttgatta gggtgatggt tcacgtagtg ggccatcgcc
421   ctgatagacg gtttttcgcc ctttgacgtt ggagtccacg ttctttaata gtggactctt
481   gttccaaact ggaacaacac tcaaccctat ctcggtctat tctttgatt tataagggat
541   tttgccgatt tcggcctatt ggttaaaaaa tgagctgatt taacaaaaat ttaacgcgaa
601   ttttaacaaa atattaacgt ttacaattc aggtggcact tttcggggaa atgtgcgcgg
661   aacccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt tgaaaaagc cgtttctgta atgaaggaga aaactcaccg aggcagttcc
841   ataggatggc aagatcctgg tatcggtctg cgattccgac tcgtccaaca tcaatacaac
901   ctattaattt ccctcgtca aaataaggt tatcaagtga gaaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
```

FIG._16I-1

```
1141  aatgcaaccg gcgcaggaac actgccagcg catcaacaat attttcacct gaatcaggat
1201  attcttctaa tacctggaat gctgttttcc cggggatcgc agtggtgagt aaccatgcat
1261  catcaggagt acggataaaa tgcttgatgg tcggaagagg cataaattcc gtcagccagt
1321  ttagtctgac catctcatct gtaacatcat tggcaacgct acctttgcca tgtttcagaa
1381  acaactctgg cgcatcgggc ttcccataca atcgatagat tgtcgcacct gattgcccga
1441  cattatcgcg agcccattta tacccatata aatcagcatc catgttggaa tttaatcgcg
1501  gcctagagca agacgtttcc cgttgaatat ggctcataac accccttgta ttactgttta
1561  tgtaagcaga cagttttatt gttcatgacc aaaatccctt aacgtgagtt ttcgttccac
1621  tgagcgtcag accccgtaga aagatcaaa ggatcttctt gagatccttt ttttctgcgc
1681  gtaatctgct gcttgcaaac aaaaaaacca ccgctaccag cggtggtttg tttgccggat
1741  caagagctac caactctttt tccgaaggta actggcttca gcagagcgca gataccaaat
1801  actgtccttc tagtgtagcc gtagttaggc caccacttca agaactctgt agcaccgcct
1861  acatacctcg ctctgctaat cctgttacca gtggctgctg ccagtggcga taagtcgtgt
1921  cttaccgggt tggactcaag acgatagtta ccggataagg cgcagcggtc gggctgaacg
1981  gggggttcgt gcacacagcc cagcttggag cgaacgacct acaccgaact gagataccta
2041  cagcgtgagc tatgagaaag cgccacgctt cccgaaggga gaaaggcgga caggtatccg
2101  gtaagcggca gggtcggaac aggagagcgc acgagggagc ttccaggggg aaacgcctgg
2161  tatctttata gtcctgtcgg gtttcgccac ctctgacttg agcgtcgatt tttgtgatgc
2221  tcgtcagggg ggcggagcct atggaaaaac gccagcaacg cggccttttt acggttcctg
2281  gccttttgct ggccttttgc tcacatgttc tttcctgcgt tatcccctga ttctgtggat
2341  aaccgtatta ccgcctttga gtgagctgat accgctcgcc gcagccgaac gaccgagcgc
2401  agcgagtcag tgagcgagga agcggaagag cgcctgatgc ggtatttct ccttacgcat
2461  ctgtgcggta tttcacaccg catatatggt gcactctcag tacaatctgc tctgatgccg
2521  catagttaag ccagtataca ctccgctatc gctacgtgac tgggtcatgg ctgcgccccg
2581  acacccgcca cacccgctg acgcgcctg acgggcttgt ctgctccgg catccgctta
2641  cagacaagct gtgaccgtct ccgggagctg catgtgtcag aggttttcac cgtcatcacc
2701  gaaacgcgcg aggcagctgc ggtaaagctc atcagcgtgg tcgtgaagcg attcacagat
2761  gtctgcctgt tcatccgcgt ccagctcgtt gagtttctcc agaagcgtta atgtctggct
2821  tctgataaag cgggccatgt taagggcggt ttttcctgt ttggtcactg atgcctccgt
2881  gtaaggggga tttctgttca tgggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa aatcactcag ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagcgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga acctgtcgt gccagctgca
3721  ttaatgaatc ggccaacgcg cggggagagg cggtttgcgt attgggcgcc agggtggttt
3781  ttcttttcac cagtgagacg ggcaacagct gattgccctt caccgcctgg ccctgagaga
3841  gttgcagcaa gcggtccacg ctggtttgcc ccagcaggcg aaaatcctgt tgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaaccgga catggcactc cagtcgcctt cccgttccgc tatcggctga atttgattgc
```

FIG._16I-2

```
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt tttcccgcgt tttcgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctccctta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
4981  accatacccca cgccgaaaca agcgctcatg agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actatagggg aattgtgagc ggataacaat tcccctctag aaataatttt gtttaacttt
5221  aagaaggaga tatacatatg aaagaaacg ctgctgctaa attcgaacgc agcacatgg
5281  acagcccaga tctgggtacc ctggtgccac gcggttccat ggctgatatc agatctaatg
5341  gtctcgaaac tcacaacaca aggctctgta tcgtaggaag tggcccagcg gcacacacgg
5401  cggcgattta cgcagctagg gctgaactta aacctcttct cttcgaagga tggatggcta
5461  acgacatcgc tcccggtggt caactaacaa ccaccaccga cgtcgagaat ttccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
5821  cggtgatcgg tggaggcgat tcagcaatgg aagaagcaaa ctttcttaca aaatatggat
5881  ccaaagtgta tataatccat cgctttgatg cttttaacgc gtctaagatt atgcagcagc
5941  gcgctttgtc taatcctaag attgatgtga tttggaactc gtctgttgtg gaagcttatg
6001  gagatggaga aagagatgtg cttggaggat tgaaagtgaa gaatgtggtt accggtgatg
6061  tttctgattt aaaagtttct ggattgttct tgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg atggagtcga caagcttgcg gccgcac
```

FIG._16I-3

**The RRR-WT variant coding sequence with S-tag at the N-terminus,
His-Tag at C-terminus (5238-26)**

```
   1    tcgagcacca ccaccaccac cactgagatc cggctgctaa caaagcccga aaggaagctg
  61    agttggctgc tgccaccgct gagcaataac tagcataacc ccttggggcc tctaaacggg
 121    tcttgagggg ttttttgctg aaaggaggaa ctatatccgg attggcgaat gggacgcgcc
 181    ctgtagcggc gcattaagcg cggcgggtgt ggtggttacg cgcagcgtga ccgctacact
 241    tgccagcgcc ctagcgcccg ctcctttcgc tttcttccct tcctttctcg ccacgttcgc
 301    cggctttccc cgtcaagctc taaatcgggg ctcccttta gggttccgat ttagtgcttt
 361    acggcacctc gaccccaaaa aacttgatta gggtgatggt tcacgtagtg ggccatcgcc
 421    ctgatagacg gtttttcgcc ctttgacgtt ggagtccacg ttctttaata gtggactctt
 481    gttccaaact ggaacaacac tcaaccctat ctcggtctat tcttttgatt tataagggat
 541    tttgccgatt tcggcctatt ggttaaaaaa tgagctgatt taacaaaaat ttaacgcgaa
 601    ttttaacaaa atattaacgt ttacaatttc aggtggcact tttcggggaa atgtgcgcgg
 661    aaccccatt tgtttatttt tctaaataca ttcaaatatg tatccgctca tgaattaatt
 721    cttagaaaaa ctcatcgagc atcaaatgaa actgcaattt attcatatca ggattatcaa
 781    taccatattt tgaaaaagc cgtttctgta atgaaggaga aaactcaccg aggcagttcc
 841    ataggatggc aagatcctgg tatcggtctg cgattccgac tcgtccaaca tcaatacaac
 901    ctattaattt ccctcgtca aaataaggt tatcaagtga aaatcacca tgagtgacga
 961    ctgaatccgg tgagaatggc aaaagtttat gcatttcttt ccagacttgt tcaacaggcc
1021    agccattacg ctcgtcatca aaatcactcg catcaaccaa accgttattc attcgtgatt
1081    gcgcctgagc gagacgaaat acgcgatcgc tgttaaaagg acaattacaa acaggaatcg
1141    aatgcaaccg gcgcaggaac actgccagcg catcaacaat attttcacct gaatcaggat
1201    attcttctaa tacctggaat gctgttttcc cggggatcgc agtggtgagt aaccatgcat
1261    catcaggagt acggataaaa tgcttgatgg tcggaagagg cataaattcc gtcagccagt
1321    ttagtctgac catctcatct gtaacatcat tggcaacgct acctttgcca tgtttcagaa
1381    acaactctgg cgcatcgggc ttcccataca atcgatagat tgtcgcacct gattgcccga
1441    cattatcgcg agcccattta tacccatata atcagcatc catgttggaa tttaatcgcg
1501    gcctagagca agacgtttcc cgttgaatat ggctcataac accccttgta ttactgttta
1561    tgtaagcaga cagttttatt gttcatgacc aaaatccctt aacgtgagtt ttcgttccac
1621    tgagcgtcag accccgtaga aagatcaaa ggatcttctt gagatccttt ttttctgcgc
1681    gtaatctgct gcttgcaaac aaaaaaacca ccgctaccag cggtggtttg tttgccggat
1741    caagagctac caactctttt tccgaaggta actggcttca gcagagcgca gataccaaat
1801    actgtccttc tagtgtagcc gtagttaggc caccacttca agaactctgt agcaccgcct
1861    acatacctcg ctctgctaat cctgttacca gtggctgctg ccagtggcga taagtcgtgt
1921    cttaccgggt tggactcaag acgatagtta ccggataagg cgcagcggtc gggctgaacg
1981    gggggttcgt gcacacagcc cagcttggag cgaacgacct acaccgaact gagatacccta
2041    cagcgtgagc tatgagaaag cgccacgctt cccgaaggga gaaaggcgga caggtatccg
2101    gtaagcggca gggtcggaac aggagagcgc acgagggagc ttccaggggg aaacgcctgg
2161    tatctttata gtcctgtcgg gtttcgccac ctctgacttg agcgtcgatt tttgtgatgc
2221    tcgtcagggg gcggagcct atggaaaaac gccagcaacg cggccttttt acggttcctg
2281    gccttttgct ggccttttgc tcacatgttc tttcctgcgt tatccctga ttctgtggat
2341    aaccgtatta ccgcctttga gtgagctgat accgctcgcc gcagccgaac gaccgagcgc
2401    agcgagtcag tgagcgagga agcggaagag cgcctgatgc ggtattttct ccttacgcat
2461    ctgtgcggta tttcacaccg catatatggt gcactctcag tacaatctgc tctgatgccg
2521    catagttaag ccagtataca ctccgctatc gctacgtgac tgggtcatgg ctgcgccccg
2581    acacccgcca cacccgctg acgcgcctg acgggcttgt ctgctcccgg catccgctta
2641    cagacaagct gtgaccgtct ccgggagctg catgtgtcag aggttttcac cgtcatcacc
2701    gaaacgcgcg aggcagctgc ggtaaagctc atcagcgtgg tcgtgaagcg attcacagat
2761    gtctgcctgt tcatccgcgt ccagctcgtt gagtttctcc agaagcgtta atgtctggct
```

FIG._16J-1

```
2821  tctgataaag cgggccatgt taagggcggt tttttcctgt ttggtcactg atgcctccgt
2881  gtaagggga  tttctgttca tggggtaat  gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa atcactcag  ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagccgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg ataccgcaa  gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga acctgtcgt  gccagctgca
3721  ttaatgaatc ggccaacgcg cggggagagg cggtttgcgt attgggcgcc agggtggttt
3781  ttcttttcac cagtgagacg ggcaacagct gattgccctt caccgcctgg ccctgagaga
3841  gttgcagcaa gcggtccacg ctggtttgcc ccagcaggcg aaaatcctgt tgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaaccgga catggcactc cagtcgcctt cccgttccgc tatcggctga atttgattgc
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt ttcccgcgt  tttcgcagaa acgtggctgg
4681  cctggttcac cacgcgggaa acggtctgat aagagacacc ggcatactct gcacatcgt
4741  ataacgttac tggtttcaca ttcaccaccc tgaattgact ctcttcgggg cgctatcatg
4801  ccataccgcg aaaggttttg cgccattcga tggtgtccgg gatctcgacg ctctccctta
4861  tgcgactcct gcattaggaa gcagcccagt agtaggttga ggccgttgag caccgccgcc
4921  gcaaggaatg gtgcatgcaa ggagatggcg cccaacagtc cccggccac  ggggcctgcc
4981  accataccca cgccgaaaca gcgctcatg  agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actataggg  aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tgcccagcg  gcacacacgg
5401  cggcgattta cgcagctagg gctgaactta accctcttct cttcgaagga tggatggcta
5461  acgacatcgc tcccggtggt caactaacaa ccaccaccga cgtcgagaat tccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
```

FIG._16J-2

```
5821 cggtgatcgg tggaggcgat tcagcaatgg aagaagcaaa ctttcttaca aaatatggat
5881 ccaaagtgta tataatccat cgccgcgatg cttttcgtgc gtctaagatt atgcagcagc
5941 gcgctttgtc taatcctaag attgatgtga tttggaactc gtctgttgtg gaagcttatg
6001 gagatggaga aagagatgtg cttggaggat tgaaagtgaa gaatgtggtt accggtgatg
6061 tttctgattt aaaagtttct ggattgttct ttgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg atggagtcga caagcttgcg gccgcac
```

FIG._16J-3

The WVG variant coding sequence with S-tag
at the N-terminus (5238-6335)

```
1    tcgagcacca ccaccaccac cactgagatc cggctgctaa caaagcccga aggaagctg
61   agttggctgc tgccaccgct gagcaataac tagcataacc ccttggggcc tctaaacggg
121  tcttgagggg ttttttgctg aaaggaggaa ctatatccgg attggcgaat gggacgcgcc
181  ctgtagcggc gcattaagcg cggcgggtgt ggtggttacg cgcagcgtga ccgctacact
241  tgccagcgcc ctagcgcccg ctcctttcgc tttcttccct tcctttctcg ccacgttcgc
301  cggctttccc cgtcaagctc taaatcgggg ctcccttta ggttccgat ttagtgcttt
361  acggcacctc gaccccaaaa aacttgatta gggtgatggt tcacgtagtg gccatcgcc
421  ctgatagacg gtttttcgcc ctttgacgtt ggagtccacg ttctttaata gtggactctt
481  gttccaaact ggaacaacac tcaaccctat ctcggtctat tcttttgatt tataagggat
541  tttgccgatt tcggcctatt ggttaaaaaa tgagctgatt taacaaaaat ttaacgcgaa
601  ttttaacaaa atattaacgt ttacaatttc aggtggcact tttcggggaa atgtgcgcgg
661  aacccctatt tgtttatttt tctaaataca ttcaaatatg tatccgctca tgaattaatt
721  cttagaaaaa ctcatcgagc atcaaatgaa actgcaattt attcatatca ggattatcaa
781  taccatattt ttgaaaaagc cgtttctgta atgaaggaga aaactcaccg aggcagttcc
841  ataggatggc aagatcctgg tatcggtctg cgattccgac tcgtccaaca tcaatacaac
901  ctattaattt cccctcgtca aaaataaggt tatcaagtga aaatcacca tgagtgacga
961  ctgaatccgg tgagaatggc aaaagtttat gcatttcttt ccagacttgt tcaacaggcc
1021 agccattacg ctcgtcatca aaatcactcg catcaaccaa accgttattc attcgtgatt
1081 gcgcctgagc gagacgaaat acgcgatcgc tgttaaaagg acaattacaa acaggaatcg
1141 aatgcaaccg gcgcaggaac actgccagcg catcaacaat attttcacct gaatcaggat
1201 attcttctaa tacctggaat gctgttttcc cggggatcgc agtggtgagt aaccatgcat
1261 catcaggagt acggataaaa tgcttgatgg tcggaagagg cataaattcc gtcagccagt
1321 ttagtctgac catctcatct gtaacatcat tggcaacgct acctttgcca tgtttcagaa
1381 acaactctgg cgcatcgggc ttcccataca atcgatagat tgtcgcacct gattgcccga
1441 cattatcgcg agcccattta tacccatata atcagcatc catgttggaa tttaatcgcg
1501 gcctagagca agacgtttcc cgttgaatat ggctcataac accccttgta ttactgttta
1561 tgtaagcaga cagtttatt gttcatgacc aaaatccctt aacgtgagtt ttcgttccac
1621 tgagcgtcag accccgtaga aagatcaaa ggatcttctt gagatccttt ttttctgcgc
1681 gtaatctgct gcttgcaaac aaaaaaacca ccgctaccag cggtggtttg tttgccggat
1741 caagagctac caactctttt tccgaaggta actggcttca gcagagcgca gataccaaat
1801 actgtccttc tagtgtagcc gtagttaggc caccacttca agaactctgt agcaccgcct
1861 acatacctcg ctctgctaat cctgttacca gtggctgctg ccagtggcga taagtcgtgt
1921 cttaccgggt tggactcaag acgatagtta ccggataagg cgcagcggtc gggctgaacg
1981 gggggttcgt gcacacagcc cagcttggag cgaacgacct acaccgaact gagataccta
```

FIG._16K-1

```
2041  cagcgtgagc tatgagaaag cgccacgctt cccgaaggga gaaaggcgga caggtatccg
2101  gtaagcggca gggtcggaac aggagagcgc acgagggagc ttccaggggg aaacgcctgg
2161  tatctttata gtcctgtcgg gtttcgccac ctctgacttg agcgtcgatt tttgtgatgc
2221  tcgtcagggg ggcggagcct atggaaaaac gccagcaacg cggcctttt acggttcctg
2281  gcctttgct ggcctttgc tcacatgttc tttcctgcgt tatcccctga ttctgtggat
2341  aaccgtatta ccgcctttga gtgagctgat accgctcgcc gcagccgaac gaccgagcgc
2401  agcgagtcag tgagcgagga agcggaagag cgcctgatgc ggtattttct ccttacgcat
2461  ctgtgcggta tttcacaccg catatatggt gcactctcag tacaatctgc tctgatgccg
2521  catagttaag ccagtataca ctccgctatc gctacgtgac tgggtcatgg ctgcgccccg
2581  acacccgcca acacccgctg acgcgccctg acgggcttgt ctgctcccgg catccgctta
2641  cagacaagct gtgaccgtct ccgggagctg catgtgtcag aggttttcac cgtcatcacc
2701  gaaacgcgcg aggcagctgc ggtaaagctc atcagcgtgg tcgtgaagcg attcacagat
2761  gtctgcctgt tcatccgcgt ccagctcgtt gagtttctcc agaagcgtta atgtctggct
2821  tctgataaag cgggccatgt taagggcggt ttttcctgt tggtcactg atgcctccgt
2881  gtaaggggga tttctgttca tgggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa aatcactcag ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagccgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga aacctgtcgt gccagctgca
3721  ttaatgaatc ggccaacgcg cggggagagg cggtttgcgt attgggcgcc agggtggttt
3781  ttcttttcac cagtgagacg ggcaacagct gattgccctt caccgcctgg ccctgagaga
3841  gttgcagcaa gcggtccacg ctggtttgcc ccagcaggcg aaaatcctgt ttgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaaccgga catggcactc cagtcgcctt cccgttccgc tatcggctga atttgattgc
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt tttcccgcgt tttcgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctcccta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
4981  accatacccca cgccgaaaca agcgctcatg agcccgaagt ggcgagcccg atcttcccca
```

FIG. 16K-2

```
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actatagggg aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tggcccagcg cacacacgg
5401  cggcgattta cgcagctagg gctgaactta aacctcttct cttcgaagga tggatggcta
5461  acgacatcgc tcccggtggt caactaacaa ccaccaccga cgtcgagaat ttccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
5821  cggtgatcgg tggaggcgat tcagcaatgg aagaagcaaa ctttcttaca aaatatggat
5881  ccaaagtgta tataatccat tgggtggatg cttttggggc gtctaagatt atgcagcagc
5941  gcgctttgtc taatcctaag attgatgtga tttggaactc gtctgttgtg gaagcttatg
6001  gagatggaga aagagatgtg cttggaggat tgaaagtgaa gaatgtggtt accggtgatg
6061  tttctgattt aaaagtttct ggattgttct ttgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg attgagtcga caagcttgcg gccgcac
```

FIG. _16K-3

The WRS variant coding sequence with S-tag
at the N-terminus (5238-6335)

```
1     tcgagcacca ccaccaccac cactgagatc cggctgctaa caaagcccga aaggaagctg
61    agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct tcctttctcg ccacgttcgc
301   cggctttccc cgtcaagctc taaatcgggg gctcccttta gggttccgat ttagtgcttt
361   acggcacctc gaccccaaaa aacttgatta gggtgatggt tcacgtagtg ggccatcgcc
421   ctgatagacg ttttcgcc ctttgacgtt ggagtccacg ttctttaata gtggactctt
481   gttccaaact ggaacaacac tcaaccctat ctcggtctat tcttttgatt tataagggat
541   tttgccgatt tcggcctatt ggttaaaaaa tgagctgatt taacaaaaat ttaacgcgaa
601   ttttaacaaa atattaacgt ttacaatttc aggtggcact tttcggggaa atgtgcgcgg
661   aacccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt ttgaaaaagc cgtttctgta atgaaggaga aaactcaccg aggcagttcc
841   ataggatggc aagatcctgg tatcggtctg cgattccgac tcgtccaaca tcaatacaac
901   ctattaattt cccctcgtca aaataaggt tatcaagtga aaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
```

FIG. _16L-1

```
1261 catcaggagt acggataaaa tgcttgatgg tcggaagagg cataaattcc gtcagccagt
1321 ttagtctgac catctcatct gtaacatcat tggcaacgct acctttgcca tgtttcagaa
1381 acaactctgg cgcatcgggc ttcccataca atcgatagat tgtcgcacct gattgcccga
1441 cattatcgcg agcccattta tacccatata aatcagcatc catgttggaa tttaatcgcg
1501 gcctagagca agacgtttcc cgttgaatat ggctcataac accccttgta ttactgttta
1561 tgtaagcaga cagttttatt gttcatgacc aaaatccctt aacgtgagtt ttcgttccac
1621 tgagcgtcag accccgtaga aagatcaaa ggatcttctt gagatccttt ttttctgcgc
1681 gtaatctgct gcttgcaaac aaaaaaacca ccgctaccag cggtggtttg tttgccggat
1741 caagagctac caactctttt tccgaaggta actggcttca gcagagcgca gataccaaat
1801 actgtccttc tagtgtagcc gtagttaggc caccacttca agaactctgt agcaccgcct
1861 acatacctcg ctctgctaat cctgttacca gtggctgctg ccagtggcga taagtcgtgt
1921 cttaccgggt tggactcaag acgatagtta ccggataagg cgcagcggtc gggctgaacg
1981 gggggttcgt gcacacagcc cagcttggag cgaacgacct acaccgaact gagataccta
2041 cagcgtgagc tatgagaaag cgccacgctt cccgaaggga gaaaggcgga caggtatccg
2101 gtaagcggca gggtcggaac aggagagcgc acgagggagc ttccaggggg aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggccttttt acggttcctg
2281 gccttttgct ggccttttgc tcacatgttc tttcctgcgt tatccctga ttctgtggat
2341 aaccgtatta ccgcctttga gtgagctgat accgctcgcc gcagccgaac gaccgagcgc
2401 agcgagtcag tgagcgagga gcggaagag cgcctgatgc ggtattttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgccccg
2581 acacccgcca cacccgctg acgcgccctg acgggcttgt ctgctccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt ttttcctgt ttggtcactg atgcctccgt
2881 gtaaggggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt tccagactta cgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtgggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga aacctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt tgatggtgg
3901 ttaacggcgg gatataacat gagctgtctt cggtatcgtc gtatcccact accgagatgt
3961 ccgcaccaac gcgcagcccg gactcggtaa tggcacgcat gcgcccagc gccatctgat
4021 cgttggcaac cagcatcgca gtgggaacga tgccctcatt cagcatttgc atggtttgtt
4081 gaaaccggga catggcactc cagtcgcctt ccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
```

FIG._16L-2

```
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt tttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
4981 accatacgca cgccgaaaca agcgctcatg agcccgaagt ggcgagcccg atcttcccca
5041 tcggtgatgt cggcgatata ggcgccagca accgcacctg tggcgccggt gatgccggcc
5101 acgatgcgtc cggcgtagag gatcgagatc gatctcgatc ccgcgaaatt aatacgactc
5161 actataggg aattgtgagc ggataacaat tcccctctag aaataatttt gtttaactt
5221 aagaaggaga tatacatatg aaagaaaccg ctgctgctaa attcgaacgc cagcacatgg
5281 acagcccaga tctgggtacc ctggtgccac gcggttccat ggctgatatc agatctaatg
5341 gtctcgaaac tcacaacaca aggctctgta tcgtaggaag tggcccagcg gcacacacgg
5401 cggcgattta cgcagctagg gctgaactta aacctcttct cttcgaagga tggatggcta
5461 acgacatcgc tcccggtggt caactaacaa ccaccaccga cgtcgagaat tccccggat
5521 ttccagaagg tattctcgga gtagagctca ctgacaaatt ccgtaaacaa tcggagcgat
5581 tcggtactac gatatttaca gagacggtga cgaaagtcga tttctcttcg aaaccgttta
5641 agctattcac agattccaag gccattctcg ctgacgctgt gattctcgct actggagctg
5701 tggctaagcg gcttagcttc gttggatctg gtgaaggttc tggaggtttc tggaaccgtg
5761 gaatctccgc atgcgctgtt tgcgacggag ctgctccgat attccgtaac aaacctcttg
5821 cggtgatcgg tggaggcgat tcagcaatgg aagaagcaaa ctttcttaca aaatatggat
5881 ccaaagtgta tataatccat tggagggatg cttttagtgc gtctaagatt atgcagcagc
5941 gcgctttgtc taatcctaag attgatgtga tttggaactc gtctgttgtg aagcttatg
6001 gagatggaga aagagatgtg cttggaggat tgaaagtgaa gaatgtggtt accggtgatg
6061 tttctgattt aaaagtttct ggattgttct ttgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg attgagtcga caagcttgcg gccgcac
```

FIG._16L-3

The WFQ variant coding sequence with S-tag
at the N-terminus (5238-6335)

```
   1    tcgagcacca ccaccaccac cactgagatc cggctgctaa caaagcccga aaggaagctg
  61    attggctgc tgccaccgct gagcaataac tagcataacc ccttggggcc tctaaacggg
 121    tcttgagggg ttttttgctg aaaggaggaa ctatatccgg attggcgaat gggacgcgcc
 181    ctgtagcggc gcattaagcg cggcgggtgt ggtggttacg cgcagcgtga ccgctacact
 241    tgccagcgcc ctagcgcccg ctcctttcgc tttcttccct tcctttctcg ccacgttcgc
 301    cggctttccc cgtcaagctc taaatcgggg ctcccttta gggttccgat ttagtgcttt
 361    acggcacctc gaccccaaaa aacttgatta gggtgatggt tcacgtagtg ggccatcgcc
 421    ctgatagacg gttttcgcc ctttgacgtt ggagtccacg ttctttaata gtggactctt
 481    gttccaaact ggaacaacac tcaaccctat ctcggtctat tcttttgatt tataagggat
 541    tttgccgatt tcggcctatt ggttaaaaaa tgagctgatt taacaaaaat ttaacgcgaa
 601    ttttaacaaa atattaacgt ttacaatttc aggtggcact tttcggggaa atgtgcgcgg
 661    aaccctatt tgtttatttt tctaaataca ttcaaatatg tatccgctca tgaattaatt
 721    cttagaaaaa ctcatcgagc atcaaatgaa actgcaattt attcatatca ggattatcaa
 781    taccatattt tgaaaaagc cgtttctgta atgaaggaga aaactcaccg aggcagttcc
 841    ataggatggc aagatcctgg tatcggtctg cgattccgac tcgtccaaca tcaatacaac
 901    ctattaattt ccctcgtca aaataaggt tatcaagtga aaatcacca tgagtgacga
 961    ctgaatccgg tgagaatggc aaaagtttat gcatttcttt ccagacttgt tcaacaggcc
1021    agccattacg ctcgtcatca aaatcactcg catcaaccaa accgttattc attcgtgatt
1081    gcgcctgagc gagacgaaat acgcgatcgc tgttaaaagg acaattacaa acaggaatcg
1141    aatgcaaccg cgcaggaac actgccagcg catcaacaat attttcacct gaatcaggat
1201    attcttctaa tacctggaat gctgttttcc cggggatcgc agtggtgagt aaccatgcat
1261    catcaggagt acggataaaa tgcttgatgg tcggaagagg cataaattcc gtcagccagt
1321    ttagtctgac catctcatct gtaacatcat tggcaacgct acctttgcca tgtttcagaa
1381    acaactctgg cgcatcgggc ttcccataca atcgatagat tgtcgcacct gattgcccga
1441    cattatcgcg agcccattta tacccatata aatcagcatc catgttggaa tttaatcgcg
1501    gcctagagca agacgtttcc cgttgaatat ggctcataac accccttgta ttactgttta
1561    tgtaagcaga cagttttatt gttcatgacc aaaatccctt aacgtgagtt ttcgttccac
1621    tgagcgtcag accccgtaga aagatcaaa ggatcttctt gagatccttt ttttctgcgc
1681    gtaatctgct gcttgcaaac aaaaaaacca ccgctaccag cggtggtttg tttgccggat
1741    caagagctac caactctttt tccgaaggta actggcttca gcagagcgca gataccaaat
1801    actgtccttc tagtgtagcc gtagttaggc caccacttca agaactctgt agcaccgcct
1861    acatacctcg ctctgctaat cctgttacca gtggctgctg ccagtggcga taagtcgtgt
1921    cttaccgggt tggactcaag acgatagtta ccggataagg cgcagcggtc gggctgaacg
1981    gggggttcgt gcacacagcc cagcttggag cgaacgacct acaccgaact gagatacta
2041    cagcgtgagc tatgagaaag cgccacgctt cccgaaggga aaggcgga caggtatccg
2101    gtaagcggca gggtcggaac aggagagcgc acgagggagc ttccagggg aaacgcctgg
2161    tatctttata gtcctgtcgg gtttcgccac ctctgacttg agcgtcgatt tttgtgatgc
2221    tcgtcagggg ggcggagcct atggaaaaac gccagcaacg cggccttttt acggttcctg
2281    gcctttttgct ggccttttgc tcacatgttc tttcctgcgt tatcccctga ttctgtggat
2341    aaccgtatta ccgcctttga gtgagctgat accgctcgcc gcagccgaac gaccgagcgc
2401    agcgagtcag tgagcgagga agcggaagag cgcctgatgc ggtattttct ccttacgcat
2461    ctgtgcggta tttcacaccg catatatggt gcactctcag tacaatctgc tctgatgccg
2521    catagttaag ccagtataca ctccgctatc gctacgtgac tgggtcatgg ctgcgccccg
2581    acacccgcca cacccgctg acgcgcctg acgggcttgt ctgctcccgg catccgctta
2641    cagacaagct gtgaccgtct ccgggagctg catgtgtcag aggttttcac cgtcatcacc
2701    gaaacgcgcg aggcagctgc ggtaaagctc atcagcgtgg tcgtgaagcg attcacagat
2761    gtctgcctgt tcatccgcgt ccagctcgtt gagtttctcc agaagcgtta atgtctggct
```

FIG._16M-1

```
2821  tctgataaag cgggccatgt taagggcggt ttttcctgt ttggtcactg atgcctccgt
2881  gtaaggggga tttctgttca tggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa aatcactcag ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagccgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc caccggaagg agctgactgg
3601  gttgaaggct ctcaagggca tcggtcgaga tcccggtgcc taatgagtga gctaacttac
3661  attaattgcg ttgcgctcac tgcccgcttt ccagtcggga acctgtcgt gccagctgca
3721  ttaatgaatc ggccaacgcg cggggagagg cggtttgcgt attgggcgcc agggtggttt
3781  ttcttttcac cagtgagacg ggcaacagct gattgccctt caccgcctgg ccctgagaga
3841  gttgcagcaa gcggtccacg ctggtttgcc ccagcaggcg aaaatcctgt ttgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaaccgga catggcactc cagtcgcctt cccgttccgc tatcggctga atttgattgc
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt tttcccgcgt tttgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctccctta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
4981  accataccca cgccgaaaca agcgctcatg agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actataggg aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tgggccagcg gcacacacgg
5401  cggcgattta cgcagctagg gctaactta aacctcttct cttcgaagga tggatggcta
5461  acgacatcgc tcccggtggt caactaacaa ccaccaccga cgtcgagaat ttccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
```

```
5821 cggtgatcgg tggaggcgat tcagcaatgg aagaagcaaa ctttcttaca aaatatggat
5881 ccaaagtgta tataatccat tggtttgatg cttttcaggc gtctaagatt atgcagcagc
5941 gcgctttgtc taatcctaag attgatgtga tttggaactc gtctgttgtg aagcttatg
6001 gagatggaga aagagatgtg cttggaggat tgaaagtgaa gaatgtggtt accggtgatg
6061 tttctgattt aaaagtttct ggattgttct ttgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg attgagtcga caagcttgcg gccgcac
```

FIG._16M-3

The NTR-WT (RRR-WT) coding sequence with S-tag
at the N-terminus (5238-6335)

```
1    tcgagcacca ccaccaccac cactgagatc cggctgctaa caaagcccga aaggaagctg
61   agttggctgc tgccaccgct gagcaataac tagcataacc ccttggggcc tctaaacggg
121  tcttgagggg ttttttgctg aaaggaggaa ctatatccgg attggcgaat gggacgcgcc
181  ctgtagcggc gcattaagcg cggcgggtgt ggtggttacg cgcagcgtga ccgctacact
241  tgccagcgcc ctagcgcccg ctcctttcgc tttcttccct cctttctcg ccacgttcgc
301  cggctttccc cgtcaagctc taaatcgggg gctcccttta gggttccgat ttagtgcttt
361  acggcacctc gaccccaaaa aacttgatta gggtgatggt tcacgtagtg gccatcgcc
421  ctgatagacg ttttttcgcc ctttgacgtt ggagtccacg ttctttaata gtggactctt
481  gttccaaact ggaacaacac tcaaccctat ctcggtctat tcttttgatt tataagggat
541  tttgccgatt tcggcctatt ggttaaaaaa tgagctgatt taacaaaaat ttaacgcgaa
601  ttttaacaaa atattaacgt ttacaatttc aggtggcact tttcggggaa atgtgcgcgg
661  aaccccctatt tgtttatttt tctaaataca ttcaaatatg tatccgctca tgaattaatt
721  cttagaaaaa ctcatcgagc atcaaatgaa actgcaattt attcatatca ggattatcaa
781  taccatattt ttgaaaaagc cgtttctgta atgaaggaga aaactcaccg aggcagttcc
841  ataggatggc aagatcctgg tatcggtctg cgattccgac tcgtccaaca tcaatacaac
901  ctattaattt ccctcgtca aaaataaggt tatcaagtga gaaatcacca tgagtgacga
961  ctgaatccgg tgagaatggc aaaagtttat gcatttcttt ccagacttgt tcaacaggcc
1021 agccattacg ctcgtcatca aaatcactcg catcaaccaa accgttattc attcgtgatt
1081 gcgcctgagc gagacgaaat acgcgatcgc tgttaaaagg acaattacaa acaggaatcg
1141 aatgcaaccg gcgcaggaac actgccagcg catcaacaat attttcacct gaatcaggat
1201 attcttctaa tacctggaat gctgttttcc ggggatcgc agtggtgagt aaccatgcat
1261 catcaggagt acggataaaa tgcttgatgg tcggaagagg cataaattcc gtcagccagt
1321 ttagtctgac catctcatct gtaacatcat ggcaacgct acctttgcca tgtttcagaa
1381 acaactctgg cgcatcgggc ttcccataca atcgatagat tgtcgcacct gattgcccga
1441 cattatcgcg agcccattta tacccatata atcagcatc catgttggaa tttaatcgcg
1501 gcctagagca agacgtttcc cgttgaatat ggctcataac accccttgta ttactgttta
1561 tgtaagcaga cagttttatt gttcatgacc aaaatccctt aacgtgagtt ttcgttccac
1621 tgagcgtcag accccgtaga aagatcaaa ggatcttctt gagatccttt ttttctgcgc
1681 gtaatctgct gcttgcaaac aaaaaaacca ccgctaccag cggtggtttg tttgccggat
1741 caagagctac caactctttt tccgaaggta actggcttca gcagagcgca gataccaaat
1801 actgtccttc tagtgtagcc gtagttaggc caccacttca agaactctgt agcaccgcct
1861 acatacctcg ctctgctaat cctgttacca gtggctgctg ccagtggcga taagtcgtgt
1921 cttaccgggt tggactcaag acgatagtta ccggataagg cgcagcggtc gggctgaacg
1981 ggggggttcgt gcacacagcc cagcttggag cgaacgacct acaccgaact gagatacca
```

FIG._16N-1

```
2041 cagcgtgagc tatgagaaag cgccacgctt cccgaaggga gaaaggcgga caggtatccg
2101 gtaagcggca gggtcggaac aggagagcgc acgagggagc ttccagggggg aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggccttttt acggttcctg
2281 gccttttgct ggccttttgc tcacatgttc tttcctgcgt tatcccctga ttctgtggat
2341 aaccgtatta ccgcctttga gtgagctgat accgctcgcc gcagccgaac gaccgagcgc
2401 agcgagtcag tgagcgagga agcggaagag cgcctgatgc ggtattttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgcccg
2581 acacccgcca acacccgctg acgcgccctg acgggcttgt ctgctcccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt ttttcctgt tggtcactg atgcctccgt
2881 gtaagggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt tacgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga aacctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt ttgatggtgg
3901 ttaacggcgg gatataacat gagctgtctt cggtatcgtc gtatcccact accgagatgt
3961 ccgcaccaac gcgcagcccg gactcggtaa tggcacgcat tgcgcccagc gccatctgat
4021 cgttggcaac cagcatcgca gtgggaacga tgccctcatt cagcatttgc atggtttgtt
4081 gaaaaccgga catggcactc cagtcgcctt cccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt tttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
4981 accatacccca cgccgaaaca agcgctcatg agcccgaagt ggcgagcccg atcttcccca
```

```
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actatagggg aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tggcccagcg gcacacacgg
5401  cggcgattta cgcagctagg gctgaactta aacctcttct cttcgaagga tggatggcta
5461  acgacatcgc tcccggtggt caactaacaa ccaccaccga cgtcgagaat tccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
5821  cggtgatcgg tggaggcgat tcagcaatgg aagaagcaaa ctttcttaca aaatatggat
5881  ccaaagtgta tataatccat aggagagatg cttttagagc gtctaagatt atgcagcagc
5941  gcgctttgtc taatcctaag attgatgtga tttggaactc gtctgttgtg gaagcttatg
6001  gagatggaga aagagatgtg cttggaggat tgaaagtgaa gaatgtggtt accggtgatg
6061  tttctgattt aaaagtttct ggattgttct tgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg attgagtcga caagcttgcg gccgcac
```

FIG._16N-3

The RYN-M variant coding sequence with S-tag
at the N-terminus (5238-6335)

```
1     tcgagcacca ccaccaccac cactgagatc cggctgctaa caaagcccga aaggaagctg
61    agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct tcctttctcg ccacgttcgc
301   cggctttccc cgtcaagctc taaatcgggg gctcccttta gggttccgat ttagtgcttt
361   acggcacctc gaccccaaaa aacttgatta gggtgatggt tcacgtagtg gccatcgcc
421   ctgatagacg gttttcgcc ctttgacgtt ggagtccacg ttctttaata gtggactctt
481   gttccaaact ggaacaacac tcaaccctat ctcggtctat tcttttgatt tataagggat
541   tttgccgatt tcggcctatt ggttaaaaaa tgagctgatt taacaaaaat ttaacgcgaa
601   ttttaacaaa atattaacgt ttacaatttc aggtggcact tttcggggaa atgtgcgcgg
661   aacccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt tgaaaaagc cgtttctgta atgaaggaga aaactcaccg aggcagttcc
841   ataggatggc aagatcctgg tatcggtctg cgattccgac tcgtccaaca tcaatacaac
901   ctattaattt cccctcgtca aaataaggt tatcaagtga gaaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
```

FIG._16O-1

```
1261 catcaggagt acggataaaa tgcttgatgg tcggaagagg cataaattcc gtcagccagt
1321 ttagtctgac catctcatct gtaacatcat tggcaacgct acctttgcca tgtttcagaa
1381 acaactctgg cgcatcgggc ttcccataca atcgatagat tgtcgcacct gattgcccga
1441 cattatcgcg agcccattta tacccatata aatcagcatc catgttggaa tttaatcgcg
1501 gcctagagca agacgtttcc cgttgaatat ggctcataac accccttgta ttactgttta
1561 tgtaagcaga cagttttatt gttcatgacc aaaatccctt aacgtgagtt ttcgttccac
1621 tgagcgtcag accccgtaga aaagatcaaa ggatcttctt gagatccttt ttttctgcgc
1681 gtaatctgct gcttgcaaac aaaaaaacca ccgctaccag cggtggtttg tttgccggat
1741 caagagctac caactctttt tccgaaggta actggcttca gcagagcgca gataccaaat
1801 actgtccttc tagtgtagcc gtagttaggc caccacttca agaactctgt agcaccgcct
1861 acatacctcg ctctgctaat cctgttacca gtggctgctg ccagtggcga taagtcgtgt
1921 cttaccgggt tggactcaag acgatagtta ccggataagg cgcagcggtc gggctgaacg
1981 gggggttcgt gcacacagcc cagcttggag cgaacgacct acaccgaact gagataccta
2041 cagcgtgagc tatgagaaag cgccacgctt cccgaaggga aaaggcgga caggtatccg
2101 gtaagcggca gggtcggaac aggagagcgc acgagggagc tccaggggga aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggcctttt acggttcctg
2281 gccttttgct ggccttttgc tcacatgttc tttcctgcgt tatcccctga ttctgtggat
2341 aaccgtatta ccgcctttga gtgagctgat accgctcgcc gcagccgaac gaccgagcgc
2401 agcgagtcag tgagcgagga agcggaagag cgcctgatgc ggtatttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgccccg
2581 acaccgcca acaccgctg acgcgcctg acggcttgt ctgctcccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt ttttcctgt tggtcactg atgcctccgt
2881 gtaaggggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt acgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga aacctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt ttgatggtgg
3901 ttaacggcgg gatataacat gagctgtctt cggtatcgtc gtatcccact accgagatgt
3961 ccgcaccaac gcgcagcccg gactcggtaa tggcacgcat tgcgcccagc gccatctgat
4021 cgttggcaac cagcatcgca gtgggaacga tgccctcatt cagcatttgc atggtttgtt
4081 gaaaaccgga catggcactc cagtcgcctt ccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
```

```
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt tttccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
4981 accatacccca cgccgaaaca agcgctcatg agcccgaagt ggcgagcccg atcttcccca
5041 tcggtgatgt cggcgatata ggcgccagca accgcacctg tggcgccggt gatgccggcc
5101 acgatgcgtc cggcgtagag gatcgagatc gatctcgatc ccgcgaaatt aatacgactc
5161 actatagggg aattgtgagc ggataacaat tcccctctag aaataatttt gtttaacttt
5221 aagaaggaga tatacatatg aaagaaaccg ctgctgctaa attcgaacgc cagcacatgg
5281 acagcccaga tctgggtacc ctggtgccac gcggttccat ggctgatatc agatctaatg
5341 gtctcgaaac tcaacacaca aggctctgta tcgtaggaag tggcccagcg gcacacacgg
5401 cggcgattta cgcagctagg gctgaactta aacctcttct cttcgaagga tggatggcta
5461 acgacatcgc tcccggtggt caactaacaa ccaccaccga cgtcgagaat ttccccggat
5521 ttccagaagg tattctcgga gtagagctca ctgacaaatt ccgtaaacaa tcggagcgat
5581 tcggtactac gatatttaca gagacggtga cgaaagtcga tttctcttcg aaaccgttta
5641 agctattcac agattccaag gccattctcg ctgacgctgt gattctcgct actggagctg
5701 tggctaagcg gcttagcttc gttggatctg tgaaggttc tggaggtttc tggaaccgtg
5761 gaatctccgc atgcgctgtt tgcgacggag ctgctccgat attccgtaac aaacctcttg
5821 cggtgatggg tggaggcgat tcagcaatgg aagaagcaaa ctttcttaca aaatatggat
5881 ccaaagtgta tataatccat cgctacgatg cttttaatgc gtctaagatt atgcagcagc
5941 gcgctttgtc taatcctaag attgatgtga tttggaactc gtctgttgtg gaagcttatg
6001 gagatggaga aagagatgtg cttggaggat tgaaagtgaa gaatgtggtt accggtgatg
6061 tttctgattt aaaagtttct ggattgttct tgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg attgagtcga caagcttgcg gccgcac
```

FIG._16O-3

The RYN-L variant coding sequence with S-tag
at the N-terminus (5238-6335)

```
1     tcgagcacca ccaccaccac cactgagatc cggctgctaa caaagcccga aaggaagctg
61    agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct tcctttctcg ccacgttcgc
301   cggctttccc cgtcaagctc taaatcgggg ctcccttta gggttccgat ttagtgcttt
361   acggcacctc gaccccaaaa aacttgatta gggtgatggt tcacgtagtg gccatcgcc
421   ctgatagacg ttttcgcc ctttgacgtt ggagtccacg ttctttaata gtggactctt
481   gttccaaact ggaacaacac tcaaccctat ctcggtctat tcttttgatt tataagggat
541   tttgccgatt tcggcctatt ggttaaaaaa tgagctgatt taacaaaaat ttaacgcgaa
601   ttttaacaaa atattaacgt ttacaatttc aggtggcact tttcggggaa atgtgcgcgg
661   aaccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt ttgaaaaagc cgtttctgta atgaaggaga aaactcaccg aggcagttcc
841   ataggatggc aagatcctgg tatcggtctg cgattccgac tcgtccaaca tcaatacaac
901   ctattaattt ccctcgtca aaataaggt tatcaagtga gaaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
1261  catcaggagt acggataaaa tgcttgatgg tcggaagagg cataaattcc gtcagccagt
1321  ttagtctgac catctcatct gtaacatcat tggcaacgct acctttgcca tgtttcagaa
1381  acaactctgg cgcatcgggc ttcccataca atcgatagat tgtcgcacct gattgcccga
1441  cattatcgcg agcccattta tacccatata atcagcatc catgttggaa tttaatcgcg
1501  gcctagagca agacgtttcc cgttgaatat ggctcataac accccttgta ttactgttta
1561  tgtaagcaga cagttttatt gttcatgacc aaaatccctt aacgtgagtt ttcgttccac
1621  tgagcgtcag accccgtaga aagatcaaa ggatcttctt gagatccttt ttttctgcgc
1681  gtaatctgct gcttgcaaac aaaaaaacca ccgctaccag cggtggtttg tttgccggat
1741  caagagctac caactctttt tccgaaggta actggcttca gcagagcgca gataccaaat
1801  actgtcctc tagtgtagcc gtagttaggc caccacttca agaactctgt agcaccgcct
1861  acatacctcg ctctgctaat cctgttacca gtggctgctg ccagtggcga taagtcgtgt
1921  cttaccgggt tggactcaag acgatagtta ccggataagg cgcagcggtc gggctgaacg
1981  gggggttcgt gcacacagcc cagcttggag cgaacgacct acaccgaact gagatacctra
2041  cagcgtgagc tatgagaaag cgccacgctt cccgaaggga aaaggcgga caggtatccg
2101  gtaagcggca gggtcgaac aggagagcgc acgagggagc ttccaggggg aaacgcctgg
2161  tatctttata gtcctgtcgg gtttcgccac ctctgacttg agcgtcgatt tttgtgatgc
2221  tcgtcagggg gcggagcct atggaaaaac gccagcaacg cggccttttt acggttcctg
2281  gccttttgct ggccttttgc tcacatgttc tttcctgcgt tatcccctga ttctgtggat
2341  aaccgtatta ccgcctttga gtgagctgat accgctcgcc gcagccgaac gaccgagcgc
2401  agcgagtcag tgagcgagga agcggaagag cgcctgatgc ggtattttct ccttacgcat
2461  ctgtgcggta tttcacaccg catatatggt gcactctcag tacaatctgc tctgatgccg
2521  catagttaag ccagtataca ctccgctatc gctacgtgac tgggtcatgg ctgcgccccg
2581  acacccgcca cacccgctg acgcgcctg acgggcttgt ctgctccgg catccgctta
2641  cagacaagct gtgaccgtct ccgggagctg catgtgtcag aggttttcac cgtcatcacc
2701  gaaacgcgcg aggcagctgc ggtaaagctc atcagcgtgg tcgtgaagcg attcacagat
2761  gtctgcctgt tcatccgcgt ccagctcgtt gagtttctcc agaagcgtta atgtctggct
```

FIG._16P-1

```
2821  tctgataaag cgggccatgt taagggcggt tttttcctgt ttggtcactg atgcctccgt
2881  gtaaggggga tttctgttca tgggggtaat gataccgatg aaacgagaga ggatgctcac
2941  gatacgggtt actgatgatg aacatgcccg gttactggaa cgttgtgagg gtaaacaact
3001  ggcggtatgg atgcggcggg accagagaaa atcactcag  ggtcaatgcc agcgcttcgt
3061  taatacagat gtaggtgttc cacagggtag ccagcagcat cctgcgatgc agatccggaa
3121  cataatggtg cagggcgctg acttccgcgt ttccagactt tacgaaacac ggaaaccgaa
3181  gaccattcat gttgttgctc aggtcgcaga cgttttgcag cagcagtcgc ttcacgttcg
3241  ctcgcgtatc ggtgattcat tctgctaacc agtaaggcaa ccccgccagc ctagccgggt
3301  cctcaacgac aggagcacga tcatgcgcac ccgtggggcc gccatgccgg cgataatggc
3361  ctgcttctcg ccgaaacgtt tggtggcggg accagtgacg aaggcttgag cgagggcgtg
3421  caagattccg aataccgcaa gcgacaggcc gatcatcgtc gcgctccagc gaaagcggtc
3481  ctcgccgaaa atgacccaga gcgctgccgg cacctgtcct acgagttgca tgataaagaa
3541  gacagtcata agtgcggcga cgatagtcat gccccgcgcc accggaagg  agctgactgg
3601  gttgaaggct ctcaagggca tcggtcgaga tcccggtgcc taatgagtga gctaacttac
3661  attaattgcg ttgcgctcac tgcccgcttt ccagtcggga aacctgtcgt gccagctgca
3721  ttaatgaatc ggccaacgcg cggggagagg cggtttgcgt attgggcgcc agggtggttt
3781  ttcttttcac cagtgagacg ggcaacagct gattgccctt caccgcctgg ccctgagaga
3841  gttgcagcaa gcggtccacg ctggtttgcc ccagcaggcg aaaatcctgt tgatggtgg
3901  ttaacggcgg gatataacat gagctgtctt cggtatcgtc gtatcccact accgagatgt
3961  ccgcaccaac gcgcagcccg gactcggtaa tggcacgcat tgcgcccagc gccatctgat
4021  cgttggcaac cagcatcgca gtgggaacga tgccctcatt cagcatttgc atggtttgtt
4081  gaaaaccgga catggcactc cagtcgcctt cccgttccgc tatcggctga atttgattgc
4141  gagtgagata tttatgccag ccagccagac gcagacgcgc cgagacagaa cttaatgggc
4201  ccgctaacag cgcgatttgc tggtgaccca atgcgaccag atgctccacg cccagtcgcg
4261  taccgtcttc atgggagaaa ataatactgt tgatgggtgt ctggtcagag acatcaagaa
4321  ataacgccgg aacattagtg caggcagctt ccacagcaat ggcatcctgg tcatccagcg
4381  gatagttaat gatcagccca ctgacgcgtt gcgcgagaag attgtgcacc gccgctttac
4441  aggcttcgac gccgcttcgt tctaccatcg acaccaccac gctggcaccc agttgatcgg
4501  cgcgagattt aatcgccgcg acaatttgcg acggcgcgtg cagggccaga ctggaggtgg
4561  caacgccaat cagcaacgac tgtttgcccg ccagttgttg tgccacgcgg ttgggaatgt
4621  aattcagctc cgccatcgcc gcttccactt tttcccgcgt tttcgcagaa acgtggctgg
4681  cctggttcac cacgcgggaa acggtctgat aagagacacc ggcatactct gcgacatcgt
4741  ataacgttac tggtttcaca ttcaccaccc tgaattgact ctcttccggg cgctatcatg
4801  ccataccgcg aaaggttttg cgccattcga tggtgtccgg gatctcgacg ctctccctta
4861  tgcgactcct gcattaggaa gcagcccagt agtaggttga ggccgttgag caccgccgcc
4921  gcaaggaatg gtgcatgcaa ggagatggcg cccaacagtc ccccggccac ggggcctgcc
4981  accatacccca cgccgaaaca agcgctcatg agcccgaagt ggcgagcccg atcttcccca
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actataggg  aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tggcccagcg cacacacgg
5401  cggcgattta cgcagctagg gctgaactta aacctcttct cttcgaagga tggatggcta
5461  acgacatcgc tcccggtggt caactaacaa ccaccaccga cgtcgagaat ttccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacggag ctgctccgat attccgtaac aaacctcttg
```

FIG._16P-2

```
5821  cggtgctggg tggaggcgat tcagcaatgg aagaagcaaa ctttcttaca aaatatggat
5881  ccaaagtgta tataatccat cgctacgatg cttttaatgc gtctaagatt atgcagcagc
5941  gcgctttgtc taatcctaag attgatgtga tttggaactc gtctgttgtg aagcttatg
6001  gagatggaga aagagatgtg cttggaggat tgaaagtgaa gaatgtggtt accggtgatg
6061  tttctgattt aaaagtttct ggattgttct ttgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg attgagtcga caagcttgcg ccgcac
```

FIG._16P-3

The RYN-I variant coding sequence with S-tag
at the N-terminus (5238-6335)

```
1     tcgagcacca ccaccaccac cactgagatc cggctgctaa caaagcccga aaggaagctg
61    agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct tcctttctcg ccacgttcgc
301   cggctttccc cgtcaagctc taaatcgggg ctcccttta gggttccgat ttagtgcttt
361   acggcacctc gaccccaaaa aacttgatta gggtgatggt tcacgtagtg gccatcgcc
421   ctgatagacg gtttttcgcc ctttgacgtt ggagtccacg ttctttaata gtggactctt
481   gttccaaact ggaacaacac tcaaccctat ctcggtctat tcttttgatt tataagggat
541   tttgccgatt tcggcctatt ggttaaaaaa tgagctgatt taacaaaaat ttaacgcgaa
601   ttttaacaaa atattaacgt ttacaatttc aggtggcact ttcggggaa atgtgcgcgg
661   aacccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt ttgaaaaagc cgtttctgta atgaaggaga aaactcaccg aggcagttcc
841   ataggatggc aagatcctgg tatcggtctg cgattccgac tcgtccaaca tcaatacaac
901   ctattaattt cccctcgtca aaaataaggt tatcaagtga gaaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
1261  catcaggagt acggataaaa tgcttgatgg tcggaagagg cataaattcc gtcagccagt
1321  ttagtctgac catctcatct gtaacatcat tggcaacgct acctttgcca tgtttcagaa
1381  acaactctgg cgcatcgggc ttcccataca atcgatagat tgtcgcacct gattgcccga
1441  cattatcgcg agcccattta tacccatata atcagcatc catgttggaa tttaatcgcg
1501  gcctagagca agacgtttcc cgttgaatat ggctcataac accccttgta ttactgttta
1561  tgtaagcaga cagttttatt gttcatgacc aaaatccctt aacgtgagtt ttcgttccac
1621  tgagcgtcag accccgtaga aagatcaaa ggatcttctt gagatccttt ttttctgcgc
1681  gtaatctgct gcttgcaaac aaaaaaacca ccgctaccag cggtggtttg tttgccggat
1741  caagagctac caactctttt tccgaaggta actggcttca gcagagcgca gataccaaat
1801  actgtccttc tagtgtagcc gtagttaggc caccacttca agaactctgt agcaccgcct
1861  acatacctcg ctctgctaat cctgttacca gtggctgctg ccagtggcga taagtcgtgt
1921  cttaccgggt tggactcaag acgatagtta ccggataagg cgcagcggtc gggctgaacg
1981  gggggttcgt gcacacagcc cagcttggag cgaacgacct acaccgaact gagataccta
```

FIG._16Q-1

```
2041 cagcgtgagc tatgagaaag cgccacgctt cccgaaggga gaaaggcgga caggtatccg
2101 gtaagcggca gggtcggaac aggagagcgc acgagggagc ttccaggggg aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggccttttt acggttcctg
2281 gccttttgct ggccttttgc tcacatgttc tttcctgcgt tatcccctga ttctgtggat
2341 aaccgtatta ccgcctttga gtgagctgat accgctcgcc gcagccgaac gaccgagcgc
2401 agcgagtcag tgagcgagga gcggaagag cgcctgatgc ggtatttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgccccg
2581 acacccgcca acacccgctg acgcgccctg acgggcttgt ctgctcccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt ttttcctgt tggtcactg atgcctccgt
2881 gtaaggggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt tacgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa atgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga aacctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt tgatggtgg
3901 ttaacggcgg gatataacat gagctgtctt cggtatcgtc gtatcccact accgagatgt
3961 ccgcaccaac gcgcagcccg gactcggtaa tggcacgcat gcgcccagc gccatctgat
4021 cgttggcaac cagcatcgca gtgggaacga tgccctcatt cagcatttgc atggtttgtt
4081 gaaaaccgga catggcactc cagtcgcctt cccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg acaatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt tttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctccctta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
4981 accatacccac gccgaaaca agcgctcatg agcccgaagt ggcgagcccg atcttcccca
```

FIG._16Q-2

```
5041  tcggtgatgt cggcgatata ggcgccagca accgcacctg tggcgccggt gatgccggcc
5101  acgatgcgtc cggcgtagag gatcgagatc gatctcgatc ccgcgaaatt aatacgactc
5161  actatagggg aattgtgagc ggataacaat tcccctctag aaataatttt gtttaacttt
5221  aagaaggaga tatacatatg aaagaaaccg ctgctgctaa attcgaacgc cagcacatgg
5281  acagcccaga tctgggtacc ctggtgccac gcggttccat ggctgatatc agatctaatg
5341  gtctcgaaac tcacaacaca aggctctgta tcgtaggaag tggcccagcg gcacacacgg
5401  cggcgattta cgcagctagg gctgaactta aacctcttct cttcgaagga tggatggcta
5461  acgacatcgc tcccggtggt caactaacaa ccaccaccga cgtcgagaat tccccggat
5521  ttccagaagg tattctcgga gtagagctca ctgacaaatt ccgtaaacaa tcggagcgat
5581  tcggtactac gatatttaca gagacggtga cgaaagtcga tttctcttcg aaaccgttta
5641  agctattcac agattccaag gccattctcg ctgacgctgt gattctcgct actggagctg
5701  tggctaagcg gcttagcttc gttggatctg gtgaaggttc tggaggtttc tggaaccgtg
5761  gaatctccgc atgcgctgtt tgcgacgag ctgctccgat attccgtaac aaacctcttg
5821  cggtgatcgg tggaggcgat tcagcaatgg aagaagcaaa ctttcttaca aaatatggat
5881  ccaaagtgta tataatccat cgctacgatg cttttaatgc gtctaagatt atgcagcagc
5941  gcgctttgtc taatcctaag attgatgtga tttggaactc gtctgttgtg gaagcttatg
6001  gagatggaga aagagatgtg cttggaggat tgaaagtgaa gaatgtggtt accggtgatg
6061  tttctgattt aaaagtttct ggattgttct ttgctattgg tcatgagcca gctaccaagt
6121  ttttggatgg tggtgttgag ttagattcgg atggttatgt tgtcacgaag cctggtacta
6181  cacagactag cgttcccgga gttttcgctg cgggtgatgt tcaggataag aagtataggc
6241  aagccatcac tgctgcagga actgggtgca tggcagcttt ggatgcagag cattacttac
6301  aagagattgg atctcagcaa ggtaagagtg attgagtcga caagcttgcg gccgcac
```

FIG.—16Q-3

The RYN-A variant coding sequence with S-tag at the N-terminus,
His-Tag at C-terminus (5238-26)

```
1     tcgagcacca ccaccaccac cactgagatc cggctgctaa caaagcccga aaggaagctg
61    agttggctgc tgccaccgct gagcaataac tagcataacc ccttggggcc tctaaacggg
121   tcttgagggg ttttttgctg aaaggaggaa ctatatccgg attggcgaat gggacgcgcc
181   ctgtagcggc gcattaagcg cggcgggtgt ggtggttacg cgcagcgtga ccgctacact
241   tgccagcgcc ctagcgcccg ctcctttcgc tttcttccct cctttctcg ccacgttcgc
301   cggctttccc cgtcaagctc taaatcgggg gctccctta gggttccgat ttagtgcttt
361   acggcacctc gaccccaaaa aacttgatta gggtgatggt tcacgtagtg gccatcgcc
421   ctgatagacg gttttcgcc ctttgacgtt ggagtccacg ttctttaata gtggactctt
481   gttccaaact ggaacaacac tcaaccctat ctcggtctat tctttgatt tataagggat
541   tttgccgatt tcggcctatt ggttaaaaaa tgagctgatt taacaaaaat ttaacgcgaa
601   ttttaacaaa atattaacgt ttacaatttc aggtggcact tttcggggaa atgtgcgcgg
661   aaccctatt tgtttatttt tctaaataca ttcaaatatg tatccgctca tgaattaatt
721   cttagaaaaa ctcatcgagc atcaaatgaa actgcaattt attcatatca ggattatcaa
781   taccatattt tgaaaagc cgtttctgta atgaaggaga aaactcaccg aggcagttcc
841   ataggatggc aagatcctgg tatcggtctg cgattccgac tcgtccaaca tcaatacaac
901   ctattaattt ccccctcgtca aaataaggt tatcaagtga gaaatcacca tgagtgacga
961   ctgaatccgg tgagaatggc aaaagtttat gcatttcttt ccagacttgt tcaacaggcc
1021  agccattacg ctcgtcatca aaatcactcg catcaaccaa accgttattc attcgtgatt
1081  gcgcctgagc gagacgaaat acgcgatcgc tgttaaaagg acaattacaa acaggaatcg
1141  aatgcaaccg gcgcaggaac actgccagcg catcaacaat attttcacct gaatcaggat
1201  attcttctaa tacctggaat gctgttttcc cggggatcgc agtggtgagt aaccatgcat
```

FIG.—16R-1

```
1261 catcaggagt acggataaaa tgcttgatgg tcggaagagg cataaattcc gtcagccagt
1321 ttagtctgac catctcatct gtaacatcat tggcaacgct acctttgcca tgtttcagaa
1381 acaactctgg cgcatcgggc ttcccataca atcgatagat tgtcgcacct gattgcccga
1441 cattatcgcg agcccattta tacccatata aatcagcatc catgttggaa tttaatcgcg
1501 gcctagagca agacgtttcc cgttgaatat ggctcataac accccttgta ttactgttta
1561 tgtaagcaga cagttttatt gttcatgacc aaaatccctt aacgtgagtt ttcgttccac
1621 tgagcgtcag accccgtaga aaagatcaaa ggatcttctt gagatccttt ttttctgcgc
1681 gtaatctgct gcttgcaaac aaaaaaacca ccgctaccag cggtggtttg tttgccggat
1741 caagagctac caactctttt tccgaaggta actggcttca gcagagcgca gataccaaat
1801 actgtccttc tagtgtagcc gtagttaggc caccacttca agaactctgt agcaccgcct
1861 acatacctcg ctctgctaat cctgttacca gtggctgctg ccagtggcga taagtcgtgt
1921 cttaccgggt tggactcaag acgatagtta ccggataagg cgcagcggtc gggctgaacg
1981 gggggttcgt gcacacagcc cagcttggag cgaacgacct acaccgaact gagatacct
2041 cagcgtgagc tatgagaaag cgccacgctt cccgaaggga gaaaggcgga caggtatccg
2101 gtaagcggca gggtcggaac aggagagcgc acgagggagc ttccaggggg aaacgcctgg
2161 tatctttata gtcctgtcgg gtttcgccac ctctgacttg agcgtcgatt tttgtgatgc
2221 tcgtcagggg ggcggagcct atggaaaaac gccagcaacg cggccttttt acggttcctg
2281 gccttttgct ggccttttgc tcacatgttc tttcctgcgt tatcccctga ttctgtggat
2341 aaccgtatta ccgcctttga gtgagctgat accgctcgcc gcagccgaac gaccgagcgc
2401 agcgagtcag tgagcgagga agcggaagag cgcctgatgc ggtattttct ccttacgcat
2461 ctgtgcggta tttcacaccg catatatggt gcactctcag tacaatctgc tctgatgccg
2521 catagttaag ccagtataca ctccgctatc gctacgtgac tgggtcatgg ctgcgccccg
2581 acacccgcca acacccgctg acgcgccctg acgggcttgt ctgctcccgg catccgctta
2641 cagacaagct gtgaccgtct ccgggagctg catgtgtcag aggttttcac cgtcatcacc
2701 gaaacgcgcg aggcagctgc ggtaaagctc atcagcgtgg tcgtgaagcg attcacagat
2761 gtctgcctgt tcatccgcgt ccagctcgtt gagtttctcc agaagcgtta atgtctggct
2821 tctgataaag cgggccatgt taagggcggt tttttcctgt ttggtcactg atgcctccgt
2881 gtaaggggga tttctgttca tgggggtaat gataccgatg aaacgagaga ggatgctcac
2941 gatacgggtt actgatgatg aacatgcccg gttactggaa cgttgtgagg gtaaacaact
3001 ggcggtatgg atgcggcggg accagagaaa aatcactcag ggtcaatgcc agcgcttcgt
3061 taatacagat gtaggtgttc cacagggtag ccagcagcat cctgcgatgc agatccggaa
3121 cataatggtg cagggcgctg acttccgcgt ttccagactt tacgaaacac ggaaaccgaa
3181 gaccattcat gttgttgctc aggtcgcaga cgttttgcag cagcagtcgc ttcacgttcg
3241 ctcgcgtatc ggtgattcat tctgctaacc agtaaggcaa ccccgccagc ctagccgggt
3301 cctcaacgac aggagcacga tcatgcgcac ccgtggggcc gccatgccgg cgataatggc
3361 ctgcttctcg ccgaaacgtt tggtggcggg accagtgacg aaggcttgag cgagggcgtg
3421 caagattccg aataccgcaa gcgacaggcc gatcatcgtc gcgctccagc gaaagcggtc
3481 ctcgccgaaa tgacccaga gcgctgccgg cacctgtcct acgagttgca tgataaagaa
3541 gacagtcata agtgcggcga cgatagtcat gccccgcgcc caccggaagg agctgactgg
3601 gttgaaggct ctcaagggca tcggtcgaga tcccggtgcc taatgagtga gctaacttac
3661 attaattgcg ttgcgctcac tgcccgcttt ccagtcggga aacctgtcgt gccagctgca
3721 ttaatgaatc ggccaacgcg cggggagagg cggtttgcgt attgggcgcc agggtggttt
3781 ttcttttcac cagtgagacg ggcaacagct gattgccctt caccgcctgg ccctgagaga
3841 gttgcagcaa gcggtccacg ctggtttgcc ccagcaggcg aaaatcctgt tgatggtgg
3901 ttaacggcgg gatataacat gagctgtctt cggtatcgtc gtatcccact accgagatgt
3961 ccgcaccaac gcgcagcccg gactcggtaa tggcacgcat gcgcccagc gccatctgat
4021 cgttggcaac cagcatcgca gtgggaacga tgccctcatt cagcatttgc atggtttgtt
4081 gaaaaccgga catggcactc cagtcgcctt ccgttccgc tatcggctga atttgattgc
4141 gagtgagata tttatgccag ccagccagac gcagacgcgc cgagacagaa cttaatgggc
4201 ccgctaacag cgcgatttgc tggtgaccca atgcgaccag atgctccacg cccagtcgcg
```

FIG._16R-2

```
4261 taccgtcttc atgggagaaa ataatactgt tgatgggtgt ctggtcagag acatcaagaa
4321 ataacgccgg aacattagtg caggcagctt ccacagcaat ggcatcctgg tcatccagcg
4381 gatagttaat gatcagccca ctgacgcgtt gcgcgagaag attgtgcacc gccgctttac
4441 aggcttcgac gccgcttcgt tctaccatcg acaccaccac gctggcaccc agttgatcgg
4501 cgcgagattt aatcgccgcg caatttgcg acggcgcgtg cagggccaga ctggaggtgg
4561 caacgccaat cagcaacgac tgtttgcccg ccagttgttg tgccacgcgg ttgggaatgt
4621 aattcagctc cgccatcgcc gcttccactt tttcccgcgt tttcgcagaa acgtggctgg
4681 cctggttcac cacgcgggaa acggtctgat aagagacacc ggcatactct gcgacatcgt
4741 ataacgttac tggtttcaca ttcaccaccc tgaattgact ctcttccggg cgctatcatg
4801 ccataccgcg aaaggttttg cgccattcga tggtgtccgg gatctcgacg ctctcccta
4861 tgcgactcct gcattaggaa gcagcccagt agtaggttga ggccgttgag caccgccgcc
4921 gcaaggaatg gtgcatgcaa ggagatggcg cccaacagtc ccccggccac ggggcctgcc
4981 accatacca cgccgaaaca agcgctcatg agcccgaagt ggcgagcccg atcttcccca
5041 tcggtgatgt cggcgatata ggcgccagca accgcacctg tggcgccggt gatgccggcc
5101 acgatgcgtc cggcgtagag gatcgagatc gatctcgatc ccgcgaaatt aatacgactc
5161 actataggg aattgtgagc ggataacaat tccctctag aaataatttt gtttaacttt
5221 aagaaggaga tatacatatg aaagaaaccg ctgctgctaa attcgaacgc agcacatgg
5281 acagcccaga tctgggtacc ctggtgccac gcggttccat ggctgatatc agatctaatg
5341 gtctcgaaac tcacaacaca aggctctgta tcgtaggaag tggcccagcg gcacacacgg
5401 cggcgattta cgcagctagg gctaactta aacctcttct cttcgaagga tggatggcta
5461 acgacatcgc tcccggtggt caactaacaa ccaccaccga cgtcgagaat ttcccggat
5521 ttccagaagg tattctcgga gtagagctca ctgacaaatt ccgtaaacaa tcggagcgat
5581 tcggtactac gatattaca gagacggtga cgaaagtcga tttctcttcg aaaccgttta
5641 agctattcac agattccaag gccattctcg ctgacgctgt gattctcgct actggagctg
5701 tggctaagcg gcttagcttc gttggatctg gtgaaggttc tggaggtttc tggaaccgtg
5761 gaatctccgc atgcgctgtt tgcgacggag ctgctccgat attccgtaac aaacctcttg
5821 cggtgatcgg tggaggcgat tcagcaatgg aagaagcaaa ctttcttaca aaatatggat
5881 ccaaagtgta tataatccat cgctacgatg cttttaacgc ggctaagatt atgcagcagc
5941 gcgctttgtc taatcctaag attgatgtga tttggaactc gtctgttgtg gaagcttatg
6001 gagatggaga aagagatgtg cttggaggat tgaaagtgaa gaatgtggtt accggtgatg
6061 tttctgattt aaaagtttct ggattgttct tgctattgg tcatgagcca gctaccaagt
6121 ttttggatgg tggtgttgag ttagattcgg atggttatgt tgtcacgaag cctggtacta
6181 cacagactag cgttcccgga gttttcgctg cgggtgatgt tcaggataag aagtataggc
6241 aagccatcac tgctgcagga actgggtgca tggcagcttt ggatgcagag cattacttac
6301 aagagattgg atctcagcaa ggtaagagtg atggagtcga caagcttgcg gccgcac
```

Alignment of NTR WT and New Variant Protein Sequences, as Encoded by the Expression Vector Used. Please Refer to Color Legend Below for Description of Amino Acid Positions.

```
                 *        20         *        40         *        60         *        80         *       100
RRR-WT : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
RYN    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
RYN-A  : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
RFN    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
RFN-A  : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WRT    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WLS    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WMS    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WRS    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WIS    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WFQ    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WVR    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WMG    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100
WVG    : MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGIL : 100

*       120         *       140         *       160         *       180         *       200
RRR-WT : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
RYN    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
RYN-A  : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
RFN    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
RFN-A  : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WRT    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WLS    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WMS    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WRS    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WIS    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WFQ    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WVR    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WMG    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
WVG    : GVELTDKFRKQSERFGTTIFTETVTKVDFSSKPFKLFTDSKAILADAVILATGAVAKRLSFVGSGEGSGGFWNRGISACAVCDGAAPIFRNKPLAVIGGG : 200
```

FIG.—17A-2

Alignment (positions ~210–300)

| | Sequence | |
|---|---|---|
| RRR-WT | DSAMEEANFLTKYGSKVYIIHRRDAFRASKIMQQRALSNPKIDVIWNSSVVEAYGDGERDVLGGLKVKNVVTGDVSDLKVSGLFFAIGHEPATKFLDGGV | 300 |
| RYN | DSAMEEANFLTKYGSKVYIIHRYDAFNASKIMQQRALSNPKIDVIWNSSVVEAYGDGERDVLGGLKVKNVVTGDVSDLKVSGLFFAIGHEPATKFLDGGV | 300 |
| RYN-A | DSAMEEANFLTKYGSKVYIIHRYDAFNAASKIMQQRALSNPKIDVIWNSSVVEAYGDGERDVLGGLKVKNVVTGDVSDLKVSGLFFAIGHEPATKFLDGGV | 300 |
| RFN | DSAMEEANFLTKYGSKVYIIHRFDAFNASKIMQQRALSNPKIDVIWNSSVVEAYGDGERDVLGGLKVKNVVTGDVSDLKVSGLFFAIGHEPATKFLDGGV | 300 |
| RFN-A | DSAMEEANFLTKYGSKVYIIHRFDAFNAASKIMQQRALSNPKIDVIWNSSVVEAYGDGERDVLGGLKVKNVVTGDVSDLKVSGLFFAIGHEPATKFLDGGV | 300 |
| WRT | DSAMEEANFLTKYGSKVYIIHWRDAFTASKIMQQRALSNPKIDVIWNSSVVEAYGDGERDVLGGLKVKNVVTGDVSDLKVSGLFFAIGHEPATKFLDGGV | 300 |
| WLS | DSAMEEANFLTKYGSKVYIIHWLDAFSASKIMQQRALSNPKIDVIWNSSVVEAYGDGERDVLGGLKVKNVVTGDVSDLKVSGLFFAIGHEPATKFLDGGV | 300 |
| WMS | DSAMEEANFLTKYGSKVYIIHWMDAFSASKIMQQRALSNPKIDVIWNSSVVEAYGDGERDVLGGLKVKNVVTGDVSDLKVSGLFFAIGHEPATKFLDGGV | 300 |
| WRS | DSAMEEANFLTKYGSKVYIIHWRDAFSASKIMQQRALSNPKIDVIWNSSVVEAYGDGERDVLGGLKVKNVVTGDVSDLKVSGLFFAIGHEPATKFLDGGV | 300 |
| WIS | DSAMEEANFLTKYGSKVYIIHWIDAFSASKIMQQRALSNPKIDVIWNSSVVEAYGDGERDVLGGLKVKNVVTGDVSDLKVSGLFFAIGHEPATKFLDGGV | 300 |
| WFQ | DSAMEEANFLTKYGSKVYIIHWFDAFQASKIMQQRALSNPKIDVIWNSSVVEAYGDGERDVLGGLKVKNVVTGDVSDLKVSGLFFAIGHEPATKFLDGGV | 300 |
| WVR | DSAMEEANFLTKYGSKVYIIHWVDAFRASKIMQQRALSNPKIDVIWNSSVVEAYGDGERDVLGGLKVKNVVTGDVSDLKVSGLFFAIGHEPATKFLDGGV | 300 |
| WMG | DSAMEEANFLTKYGSKVYIIHWMDAFGASKIMQQRALSNPKIDVIWNSSVVEAYGDGERDVLGGLKVKNVVTGDVSDLKVSGLFFAIGHEPATKFLDGGV | 300 |
| WVG | DSAMEEANFLTKYGSKVYIIHWVDAFGASKIMQQRALSNPKIDVIWNSSVVEAYGDGERDVLGGLKVKNVVTGDVSDLKVSGLFFAIGHEPATKFLDGGV | 300 |

Alignment (positions ~310–385)

| | Sequence | |
|---|---|---|
| RRR-WT | ELDSDGYVVTKPGTTQTSVPGVFAAGDVQDKKYRQAITAAGTGCMAALDAEHYLQEIGSQQGKSDGVDKLAAALEHHHHHH | 381 |
| RYN | ELDSDGYVVTKPGTTQTSVPGVFAAGDVQDKKYRQAITAAGTGCMAALDAEHYLQEIGSQQGKSDGVDKLAAALEHHHHHH | 381 |
| RYN-A | ELDSDGYVVTKPGTTQTSVPGVFAAGDVQDKKYRQAITAAGTGCMAALDAEHYLQEIGSQQGKSDGVDKLAAALEHHHHHH | 381 |
| RFN | ELDSDGYVVTKPGTTQTSVPGVFAAGDVQDKKYRQAITAAGTGCMAALDAEHYLQEIGSQQGKSDGVDKLAAALEHHHHHH | 381 |
| RFN-A | ELDSDGYVVTKPGTTQTSVPGVFAAGDVQDKKYRQAITAAGTGCMAALDAEHYLQEIGSQQGKSDGVDKLAAALEHHHHHH | 381 |
| WRT | ELDSDGYVVTKPGTTQTSVPGVFAAGDVQDKKYRQAITAAGTGCMAALDAEHYLQEIGSQQGKSDGVDKLAAALEHHHHHH | 381 |
| WLS | ELDSDGYVVTKPGTTQTSVPGVFAAGDVQDKKYRQAITAAGTGCMAALDAEHYLQEIGSQQGKSDGVDKLAAALEHHHHHH | 381 |
| WMS | ELDSDGYVVTKPGTTQTSVPGVFAAGDVQDKKYRQAITAAGTGCMAALDAEHYLQEIGSQQGKSD--------------- | 365 |
| WRS | ELDSDGYVVTKPGTTQTSVPGVFAAGDVQDKKYRQAITAAGTGCMAALDAEHYLQEIGSQQGKSDGVDKLAAALEHHHHHH | 381 |
| WIS | ELDSDGYVVTKPGTTQTSVPGVFAAGDVQDKKYRQAITAAGTGCMAALDAEHYLQEIGSQQGKSD--------------- | 365 |
| WFQ | ELDSDGYVVTKPGTTQTSVPGVFAAGDVQDKKYRQAITAAGTGCMAALDAEHYLQEIGSQQGKSDGVDKLAAALEHHHHHH | 381 |
| WVR | ELDSDGYVVTKPGTTQTSVPGVFAAGDVQDKKYRQAITAAGTGCMAALDAEHYLQEIGSQQGKSDGVDKLAAALEHHHHHH | 381 |
| WMG | ELDSDGYVVTKPGTTQTSVPGVFAAGDVQDKKYRQAITAAGTGCMAALDAEHYLQEIGSQQGKSDGVDKLAAALEHHHHHH | 381 |
| WVG | ELDSDGYVVTKPGTTQTSVPGVFAAGDVQDKKYRQAITAAGTGCMAALDAEHYLQEIGSQQGKSD--------------- | 365 |

LEGEND:

- Positions Designed in All TR Libraries (The RRR Region)
- Non-RRR Positions Designed in TR-2 Library
- Non-RRR Positions Designed in R1-W Library
- S to A mutation to remove potential glycosylation site
- S-tag Cleavage Site
- C-Terminal non-removable His-Tag

FIG._17B-1

Alignment of NTR WT and Variant Protein Sequences, as Encoded by the Expression Vector Used. The Mutations are Indicated in Bold and Surrounded by a Box. The Cleavage Site for Thrombin Used in S-tag Purification Strategy is Underlined and Indicated by the Arrow.

```
PileUp

MSF: 365    Type: P     Check: 750    ..

Name: RRR-WT-S-Tagged_Protein        Len:  365   Check:   37   Weight:  0
 Name: RYN-I-S-Tagged_Protein         Len:  365   Check:  177   Weight:  0
 Name: RYN-L-S-Tagged_Protein         Len:  365   Check:  255   Weight:  0
 Name: RYN-M-S-Tagged_Protein         Len:  365   Check:  281   Weight:  0

//

1                                                              50
RRR-WT-S-Tagged_Protein  MKETAAAKFE RQHMDSPDLG TLVPRGSMAD RAELKPLLFE IRSNGLETHN TRLCIVGSGP
RYN-I-S-Tagged_Protein   MKETAAAKFE RQHMDSPDLG TLVPRGSMAD RAELKPLLFE IRSNGLETHN TRLCIVGSGP
RYN-L-S-Tagged_Protein   MKETAAAKFE RQHMDSPDLG TLVPRGSMAD RAELKPLLFE IRSNGLETHN TRLCIVGSGP
RYN-M-S-Tagged_Protein   MKETAAAKFE RQHMDSPDLG TLVPRGSMAD RAELKPLLFE IRSNGLETHN TRLCIVGSGP
                                                     ↑

51                                                            100
RRR-WT-S-Tagged_Protein  AAHTAAIYAA QSERFGTTIF GWMANDIAPG GQLTTTTDVE NFPGFPEGIL
RYN-I-S-Tagged_Protein   AAHTAAIYAA QSERFGTTIF GWMANDIAPG GQLTTTTDVE NFPGFPEGIL
RYN-L-S-Tagged_Protein   AAHTAAIYAA QSERFGTTIF GWMANDIAPG GQLTTTTDVE NFPGFPEGIL
RYN-M-S-Tagged_Protein   AAHTAAIYAA QSERFGTTIF GWMANDIAPG GQLTTTTDVE NFPGFPEGIL 101                                                           150
RRR-WT-S-Tagged_Protein  GVELTDKFRK QSERFGTTIF TETVTKVDFS SKPFKLFTDS KAILADAVIL
RYN-I-S-Tagged_Protein   GVELTDKFRK QSERFGTTIF TETVTKVDFS SKPFKLFTDS KAILADAVIL
RYN-L-S-Tagged_Protein   GVELTDKFRK QSERFGTTIF TETVTKVDFS SKPFKLFTDS KAILADAVIL
RYN-M-S-Tagged_Protein   GVELTDKFRK QSERFGTTIF TETVTKVDFS SKPFKLFTDS KAILADAVIL
```

```
                     151                                                                            200
RRR-WT-S-Tagged_Protein  ATGAVAKRLS FVGSGEGSGG FWNRGISACA VCDGAAPIFR NKPLAVIGGG
RYN-I-S-Tagged_Protein   ATGAVAKRLS FVGSGEGSGG FWNRGISACA VCDGAAPIFR NKPLAVIGGG
RYN-L-S-Tagged_Protein   ATGAVAKRLS FVGSGEGSGG FWNRGISACA VCDGAAPIFR NKPLAVLGGG
RYN-M-S-Tagged_Protein   ATGAVAKRLS FVGSGEGSGG FWNRGISACA VCDGAAPIFR NKPLAVMGGG 201                                                                            250
RRR-WT-S-Tagged_Protein  DSAMEEANFL TKYGSKVYII HRRDAFRASK IMQQRALSNP KIDVIWNSSV
RYN-I-S-Tagged_Protein   DSAMEEANFL TKYGSKVYII HRYDAFNASK IMQQRALSNP KIDVIWNSSV
RYN-L-S-Tagged_Protein   DSAMEEANFL TKYGSKVYII HRYDAFNASK IMQQRALSNP KIDVIWNSSV
RYN-M-S-Tagged_Protein   DSAMEEANFL TKYGSKVYII HRYDAFNASK IMQQRALSNP KIDVIWNSSV 251                                                                            300
RRR-WT-S-Tagged_Protein  VEAYGDGERD VLGGLKVKNV VTGDVSDLKV SGLFFAIGHE PATKFLDGGV
RYN-I-S-Tagged_Protein   VEAYGDGERD VLGGLKVKNV VTGDVSDLKV SGLFFAIGHE PATKFLDGGV
RYN-L-S-Tagged_Protein   VEAYGDGERD VLGGLKVKNV VTGDVSDLKV SGLFFAIGHE PATKFLDGGV
RYN-M-S-Tagged_Protein   VEAYGDGERD VLGGLKVKNV VTGDVSDLKV SGLFFAIGHE PATKFLDGGV 301                                                                            350
RRR-WT-S-Tagged_Protein  ELDSDGYVVT KPGTTQTSVP GVFAAGDVQD KKYRQAITAA GTGCMAALDA
RYN-I-S-Tagged_Protein   ELDSDGYVVT KPGTTQTSVP GVFAAGDVQD KKYRQAITAA GTGCMAALDA
RYN-L-S-Tagged_Protein   ELDSDGYVVT KPGTTQTSVP GVFAAGDVQD KKYRQAITAA GTGCMAALDA
RYN-M-S-Tagged_Protein   ELDSDGYVVT KPGTTQTSVP GVFAAGDVQD KKYRQAITAA GTGCMAALDA 351       365
RRR-WT-S-Tagged_Protein  EHYLQEIGSQ QGKSD
RYN-I-S-Tagged_Protein   EHYLQEIGSQ QGKSD
RYN-L-S-Tagged_Protein   EHYLQEIGSQ QGKSD
RYN-M-S-Tagged_Protein   EHYLQEIGSQ QGKSD
```

FIG._17B-2

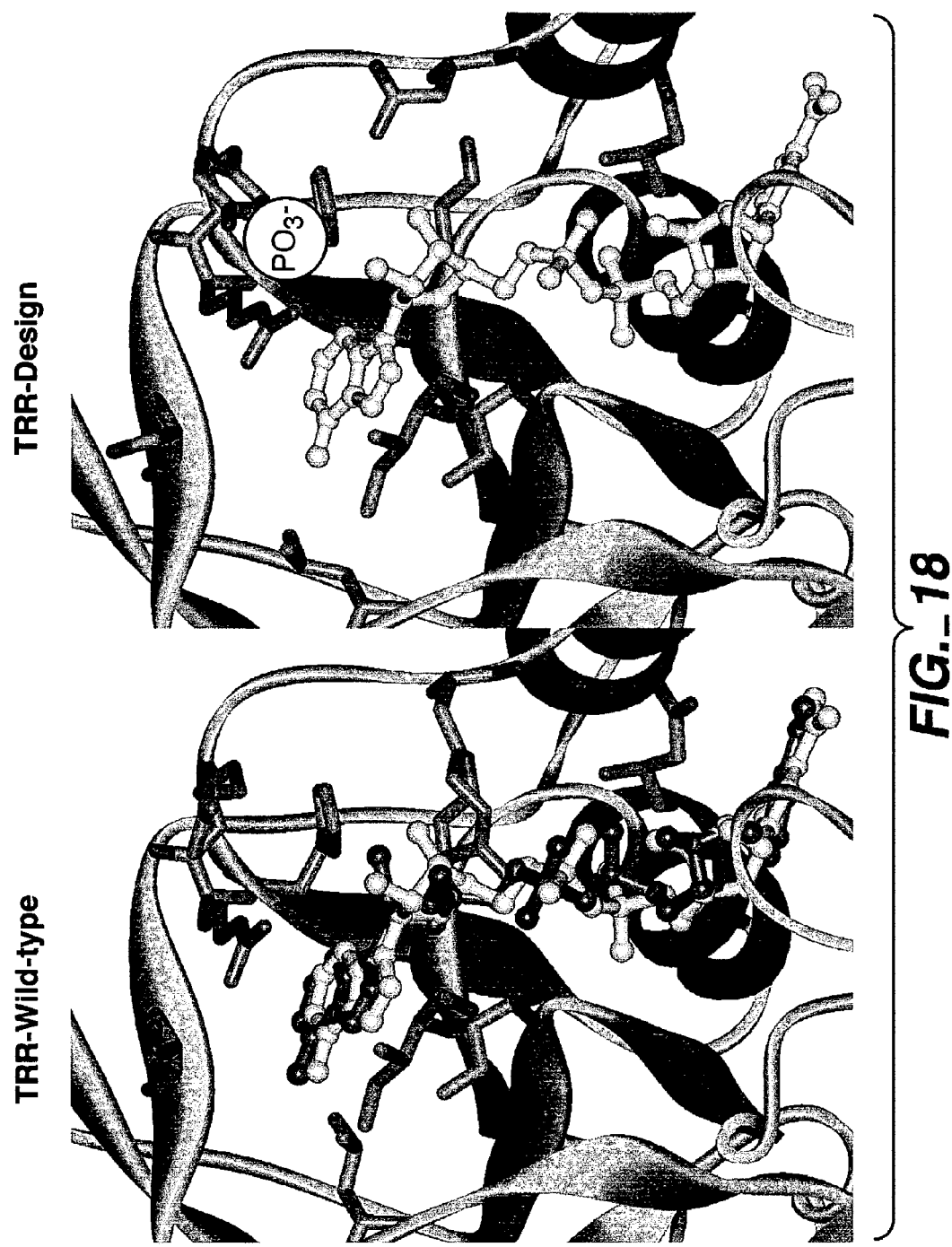

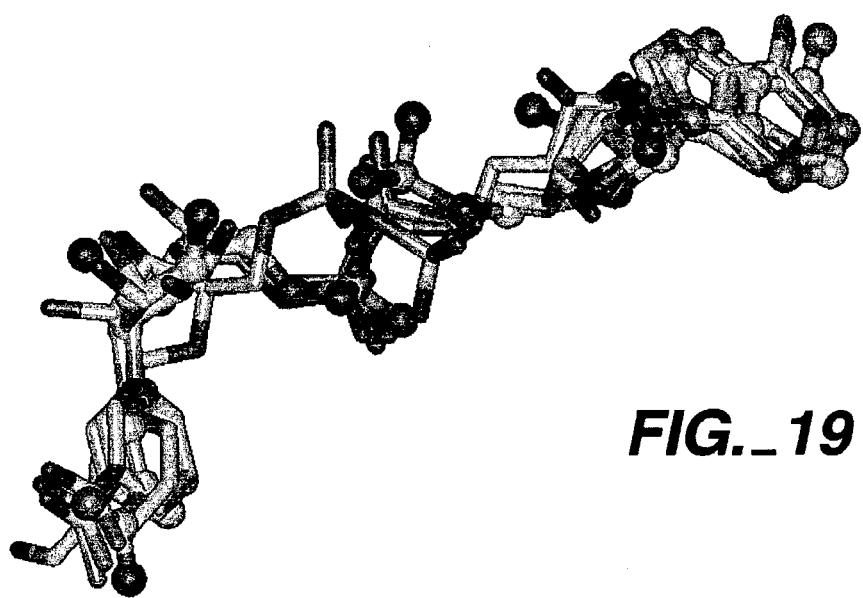
FIG._19
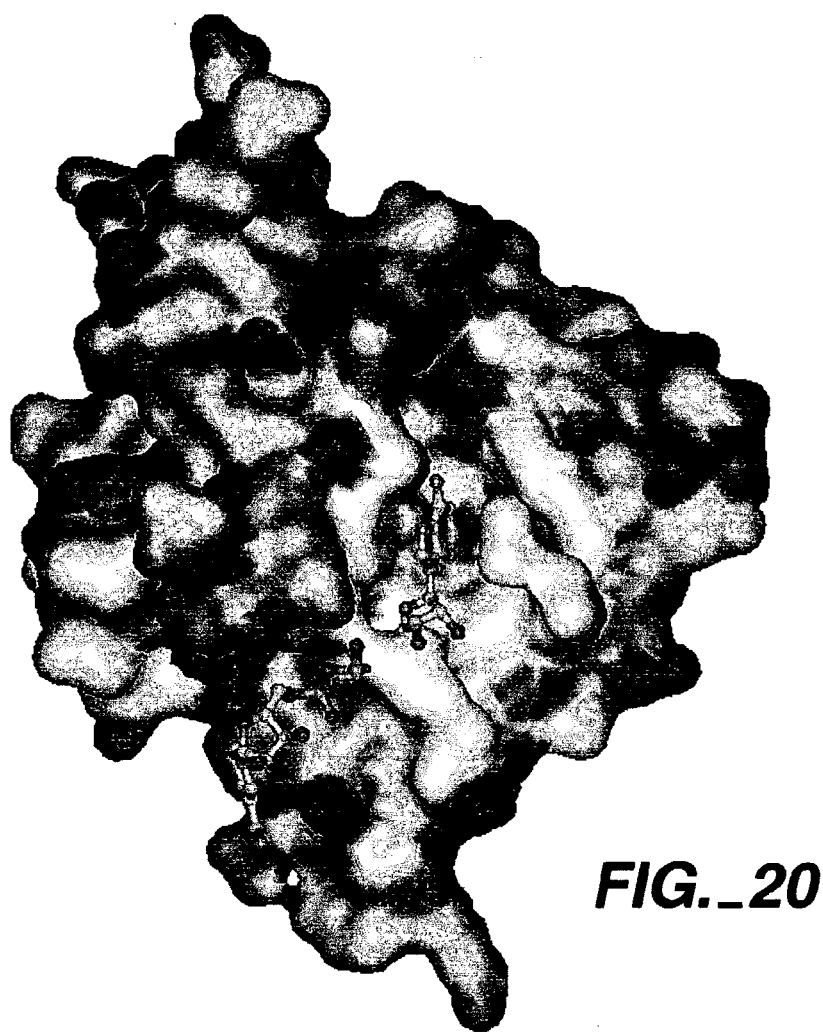
FIG._20

>sp|p09625|TRXB_ECOLI Thioredoxin reductase (EC 1.6.4.5) (TRXR) - Escherichia coli, and Escherichia coli O157:H7.

GTTKHSKLLILGSGPAGYTAAVYAARANLQPVLITGMEKGGQLTTTTEVENWPGDPNDLT
GPLLMERMHEHATKFETEIIFDHINKVDLQNRPFRLNGDNGEYTCDALIIATGASARYLG
LPSEEAFKGRGVSACATCDGFFYRNQKVAVIGGGNTAVEEALYLSNIASEVHLIHRRDGF
RAEKILIKRLMDKVENGNIILHTNRTLEEVTGDQMGVTGVRLRDTQNSDNIESLDVAGLF
VAIGHSPNTAIFEGQLELENGYIKVQSGIHGNATQTSIPGVFAAGDVMDHIYRQAITSAG
TGCMAALDAERYLDGLADAK

*FIG._21A*

>sp|P80880|TRXB_BACSU Thioredoxin reductase (EC 1.6.4.5) (TRXR) (General stress protein 35) (GSP35) – Bacillus subtilis.

SEEKIYDVIIIGAGPAGMTAAVYTSRANLSTLMIERGIPGGQMANTEDVENYPGFESILG
PELSNKMFEHAKKFGAEYAYGDIKEVIDGKEYKVVKAGSKEYKARAVIIAAGAEYKKIGV
PGEKELGGRGVSYCAVCDGAFFKGKELVVVGGGDSAVEEGVYLTRFASKVTIVHRRDKLR
AQSILQARAFDNEKVDFLWNKTVKEIHEEENGKVGNVTLVDTVTGEESEFKTDGVFIYIGM
LPLSKPFENLGITNEEGYIETNDRMETKVEGIFAAGDIREKSLRQIVTATGDGSIAAQSV
QHYVEELQETLKTLK

*FIG._21B*

>sp|P46843|TRXB_MYCLE Bifunctional Thioredoxin reductase/Thioredoxin [Includes: Thioredoxin reductase (EC 1.6.4.5) (TRXR); Thioredoxin] – Mycobacterium leprae.

MNTTPSAHETIHEVIVIGSGPAGYTAALYAARAQLTPLVFEGTSFGGALMTTTEVENYPG
FRNGITGPELMDDMREQALRFGAELRTEDVESVSLRGPIKSVVTAEGQTYQARAVILAMG
TSVRYLQIPGEQELLGRGVSACATCDGSFFRGQDIAVIGGGDSAMEEALFLTRFARSVTL
VHRRDEFRASKIMLGRARNNDKIKFITNHTVVAVNGYTTVTGLRLRNTTTGEETTLVVTG
VFVAIGHEPRSSLVSDVVDIDPDGYVLVKGRTTSTSMDGVFAAGDLVDRTYRQAITAAGS
GCAAAIDAERWLAEHAGSKANETTEETGDVDSTDTTDWSTAMTDAKNAGVTIEVTDASFF
ADVLSSNKPVLVDFWATWCGPCKMVAPVLEEIASEQRNQLTVAKLDVDTNPEMAREFQVV
SIPTMILFQGGQPVKRIVGAKGKAALLRDLSDVVPNLN

*FIG._21C*

>sp|P51978|TRXB_NEUCR Thioredoxin reductase (EC 1.6.4.5) – Neurospora crassa.

MHSKVVIIGSGPAAHTAAIYLARAELKPVLYEGFMANGIAAGGQLTTTTEIENFPGFPDG
IMGQELMDKMKAQSERFGTQIISETVAKVDLSARPFKYATEWSPEEYHTADSIILATGAS
ARRLHLPGEEKYWQNGISACAVCDGAVPIFRNKHLVVIGGGDSAAEEAMYLTKYGSHVTV
LVRKDKLRASSIMAHRLLNHEKVTVRFNTVGVEVKGDDKGLMSHLVVKDVTTGKEETLEA
NGLFYAIGHDPATALVKGQLETDADGYVVTKPGTTLTSVEGVFAAGDVQDKRYRQAITSA
GTGCMAALDAEKFLSEHEETPAEHRDTSAVQGNL

*FIG._21D*

\>sp|P29509|TRB1_YEAST Thioredoxin reductase 1 (EC 1.6.4.5)
– Saccharomyces cerevisiae (Baker's yeast).

VHNKVTIIGSGPAAHTAAIYLARAEIKPILYEGMMANGIAAGGQLTTTTEIENFPGFPDG
LTGSELMDRMREQSTKFGTEIITETVSKVDLSSKPFKLWTEFNEDAEPVTTDAIILATGA
SAKRMHLPGEETYWQKGISACAVCDGAVPIFRNKPLAVIGGGDSACEEAQFLTKYGSKVF
MLVRKDHLRASTIMQKRAEKNEKIEILYNTVALEAKGDGKLLNALRIKNTKKNEETDLPV
SGLFYAIGHTPATKIVAGQVDTDEAGYIKTVPGSSLTSVPGFFAAGDVQDSKYRQAITSA
GSGCMAALDAEKYLTSLE

FIG._21E

\>sp|P38816|TRB2_YEAST Thioredoxin reductase 2, mitochondrial
precursor (EC 1.6.4.5) – Saccharomyces cerevisiae (Baker's yeast).

MIKHIVSPFRTNFVGISKSVLSRMIHHKVTIIGSGPAAHTAAIYLARAEMKPTLYEGMMA
NGIAAGGQLTTTTDIENFPGFPESLSGSELMERMRKQSAKFGTNIITETVSKVDLSSKPF
RLWTEFNEDAEPVTTDAIILATGASAKRMHLPGEETYWQQGISACAVCDGAVPIFRNKPL
AVIGGGDSACEEAEFLTKYASKVYILVRKDHFRASVIMQRRIEKNPNIIVLFNTVALEAK
GDGKLLNMLRIKNTKSNVENDLEVNGLFYAIGHSPATDIVKGQVDEEETGYIKTVPGSSL
TSVPGFFAAGDVQDSRYRQAVTSAGSGCIAALDAERYLSAQE

FIG._21F

\>sp|Q39243|TRB1_ARATH Thioredoxin reductase 1 (EC 1.6.4.5)
(NADPH-dependent Thioredoxin reductase 1) (NTR 1)
– Arabidopsis thaliana (Mouse-ear cress).

MNGLETHNTRLCIVGSGPAAHTAAIYAARAELKPLLFEGWMANDIAPGGQLTTTTDVENF
PGFPEGILGVELTDKFRKQSERFGTTIFTETVTKVDFSSKPFKLFTDSKAILADAVILAT
GAVAKRLSFVGSGEASGGFWNRGISACAVCDGAAPIFRNKPLAVIGGGDSAMEEANFLTK
YGSKVYIIHRRDAFRASKIMQQRALSNPKIDVIWNSSVVEAYGDGERDVLGGLKVKNVVT
GDVSDLKVSGLFFAIGHEPATKFLDGGVELDSDGYVVTKPGTTQTSVPGVFAAGDVQDKK
YRQAITAAGTGCMAALDAEHYLQEIGSQQGKSD

FIG._21G

\>sp|Q39242|TRB2_ARATH Thioredoxin reductase 2 (EC 1.6.4.5)
(NADPH-dependent thioredoxin reductase 2) (NTR 2)
– Arabidopsis thaliana (Mouse-ear cress).

MCWISMSQSRFIIKSLFSTAGGFLLGSALSNPPSLATAFSSSSSSSSAAAAVDMETHKTK
VCIVGSGPAAHTAAIYASRAELKPLLFEGWMANDIAPGGQLTTTTDVENFPGFPEGILGI
DIVEKFRKQSERFGTTIFTETVNKVDFSSKPFKLFTDSRTVLADSVIISTGAVAKRLSFT
GSGEGNGGFWNRGISACAVCDGAAPIFRNKPLVVIGGGDSAMEEANFLTKYGSKVYIIHR
RDTFRASKIMQQRALSNPKIEVIWNSAVVEAYGDENGRVLGGLKVKNVVTGDVSDLKVSG
LFFAIGHEPATKFLDGQLELDEDGYVVTKPGTTKTSVVGVFAAGDVQDKKYRQAITAAGT
GCMAALDAEHYLQEIGSQEGKSD

FIG._21H

**sp|Q16881|TRXB_HUMAN Thioredoxin reductase (EC 1.6.4.5)
– Homo sapiens (Human).**

MNGPEDLPKSYDYDLIIIGGGSGGLAAAKEAAQYGKKVMVLDFVTPTPLGTRWGLGGTCV
NVGCIPKKLMHQAALLGQALQDSRNYGWKVEETVKHDWDRMIEAVQNHIGSLNWGYRVAL
REKKVVYENAYGQFIGPHRIKATNNKGKEKIYSAESFLIATGERPRYLGIPGDKEYCISS
DDLFSLPYCPGKTLVVGASYVALECAGFLAGIGLGVTVMVRSILLRGFDQDMANKIGEHM
EEHGIKFIRQFVPIKVEQIEAGTPGRLRVVAQSTNSEEIIEGEYNTVMLAIGRDACTRKI
GLETVGVKINEKTGKIPVTDEEQTNVPYIYAIGDILEDKVELTPVAIQAGRLLAQRLYAG
STVKCDYENVPTTVFTPLEYGACGLSEEKAVEKFGEENIEVYHSYFWPLEWTIPSRDNNK
CYAKIICNTKDNERVVGFHVLGPNAGEVTQGFAAALKCGLTKKQLDSTIGIHPVCAEVFT
TLSVTKRSGASILQAGC

*FIG._21I* trxB from Methanococcus jannaschii (gi|592167):

MIHDTIIIGAGPGGLTAGIYAMRGKLNALCIEKENAGGRIAEAGIVENYPGFEEIRGYEL
AEKFKNHAEKFKLPIIYDEVIKIETKERPFKVITKNSEYLTKTIVIATGTKPKKLGLNED
KFIGRGISYCTMCDAFFYLNKEVIVIGRDTPAIMSAINLKDIAKKVIVITDKSELKAAES
IMLDKLKEANNVEIIYNAKPLEIVGEERAEGVKISVNGKEEIIKADGIFISLGHVPNTEF
LKDSGIELDKKGFIKTDENCRTNIDGIYAVGDVRGGVMQVAKAVGDGCVAMANIIKYLQKL

*FIG._21J* trxB from Amhaeoglobusfulgidus (gi|2649006):

MYDVAIIGGGPAGLTAALYSARYGLKTVFFETVDPVSQLSLAAKIENYPGFEGSGMELLE
KMKEQAVKAGAEWKLEKVERVERNGETFTVIAEGGEYEAKAIIVATGGKHKEAGIEGESA
FIGRGVSYCATCDGNFFRGKKVIVYGSGKEAIEDAIYLHDIGCEVTIVSRTPSFRAEKAL
VEEVEKRGIPVHYSTTIRKIIGSGKVEKVVAYNREKKEEFEIEADGIFVAIGMRPATDVV
AELGVERDSMGYIKVDKEQRTNVEGVFAAGDCCDNPLKQVVTACGDGAVAAYSAYKYLTS.

*FIG._21K*

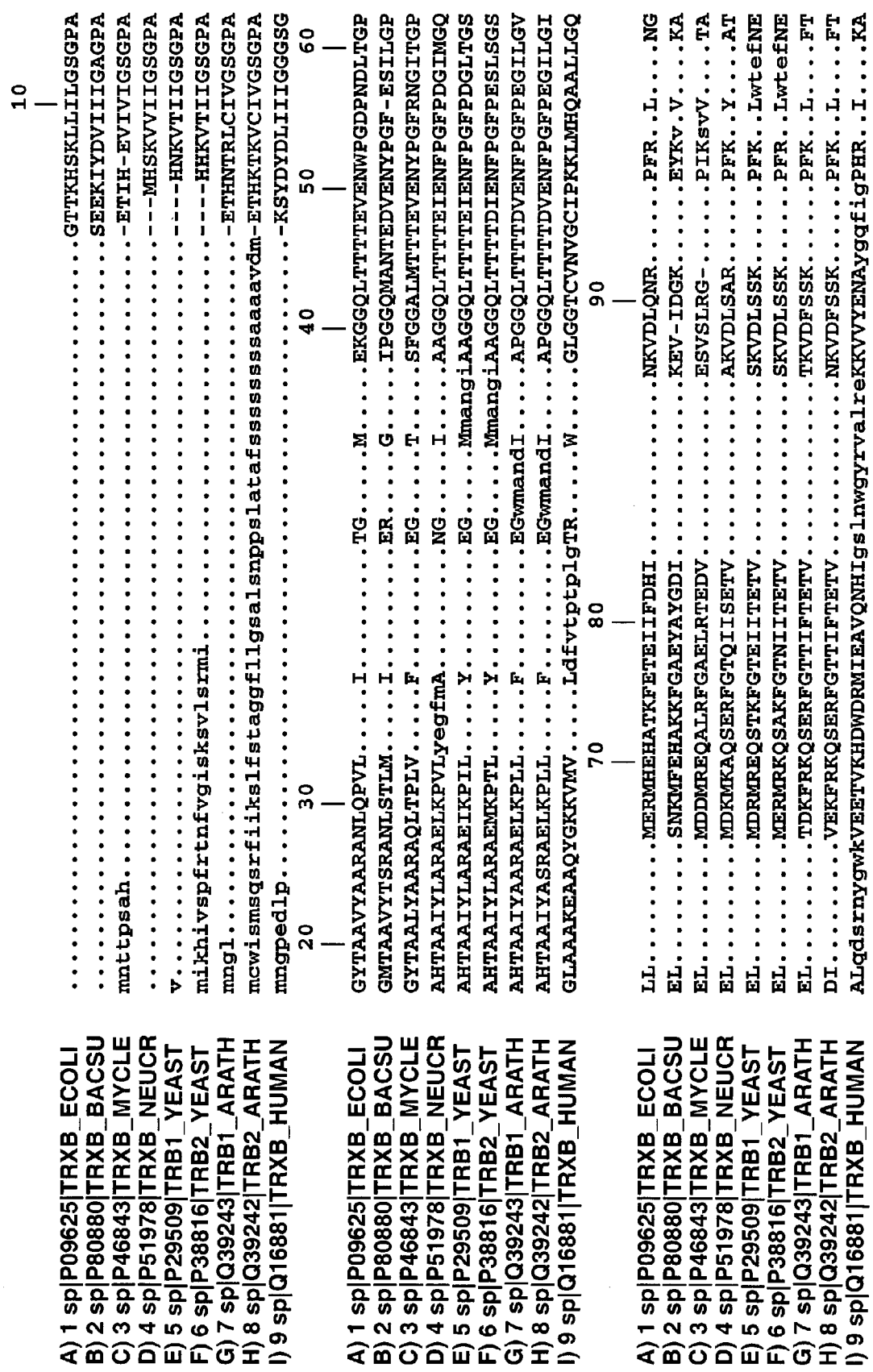
FIG._22A

```
                                                                 100                  110                  120                  130                  140
A) 1 sp|P09625|TRXB_ECOLI        D...NGE......YTCDALIIATGASARYLG.L.....PSEEA...FKGRGVSACATCDGF..F....YRNQK
B) 2 sp|P80880|TRXB_BACSU        G...SKE......YKARAVIIAAGAEYKKIG.V....PGEKE...LGGRGVSYCAVCDGA..F....FKGKE
C) 3 sp|P46843|TRXB_MYCLE        E...GQT......YQARAVILAMGTSVRYLQ.I....PGEQE...LLGRGVSACATCDGS..F....FRGQD
D) 4 sp|P51978|TRXB_NEUCR        EwspEEY......HTADSIILATGASARRLH.L....PGEEK...YWQNGISACAVCDGAvpI...FRNKH
E) 5 sp|P29509|TRB1_YEAST        D...AEP......VTTDAIILATGASAKRMH.L....PGEET...YWQKGISACAVCDGAvpI...FRNKP
F) 6 sp|P38816|TRB2_YEAST        D...AEP......VTTDAIILATGASAKRMH.L....PGEET...YWQQGISACAVCDGAvpI...FRNKP
G) 7 sp|Q39243|TRB1_ARATH        D...SKA......ILADAVILATGAVAKRLSfV....GSGEAsggFWNRGISACAVCDGAapI...FRNKP
H) 8 sp|Q39242|TRB2_ARATH        D...SRT......VLADSVIISTGAVAKRLS.FtgsgEGNGG...FWNRGISACAVCDGAapI...FRNKP
I) 9 sp|Q16881|TRXB_HUMAN        T...NNKgkekiYSAESFLIATGERPRYLG.I.....PGDKE...Y------CISSDDL..FslpYCPGK
                                  150                  160                  170                  180                  190                  200                  210

A) 1 sp|P09625|TRXB_ECOLI        VAVIGGGNTAVEEALYLSNIASEVHLIHRRDGFRA.EKILIKRLMDKVENGNIILHTNRTLEEVTGD..Q
B) 2 sp|P80880|TRXB_BACSU        LVVVGGGDSAVEEGVYLTRFASKVTIVRRDKLRA.QSILQARAFD---NEKVDFLWNKTVKEIHEE..N
C) 3 sp|P46843|TRXB_MYCLE        IAVIGGGDSAMEEEALFLTRFARSVTLVHRRDEFRA.SKIMLGRARN---NDKIKFITNHTVAVNG-.Y
D) 4 sp|P51978|TRXB_NEUCR        LVVIGGGDSAAEEAMYLTKYGSHVTVLVRKDKLRA.SSIMAHRLLN---HEKVTVRFNTVGVEVKGD..D
E) 5 sp|P29509|TRB1_YEAST        LAVIGGGDSACEEAQFLTKYGSKVFMLVRKDHLRA.STIMQKR---AEKNEKIEILYNTVALEAKGD..G
F) 6 sp|P38816|TRB2_YEAST        LAVIGGGDSACEEAEFLTKYASKVYILVRKDHFRA.SVIMQRRI---EKNPNIIVLFNTVALEAKGD..G
G) 7 sp|Q39243|TRB1_ARATH        LAVIGGGDSAMEEANFLTKYGSKVYIIHRRDAFRA.SKIMQQRAL---SNPKIDVIWNSSVVEAYGDgeR
H) 8 sp|Q39242|TRB2_ARATH        LVVIGGGDSAMEEANFLTKYGSKVYIIHRRDTFRA.SKIMQQRAL---SNPKIEVIWNSAVVEAYGD..E
I) 9 sp|Q16881|TRXB_HUMAN        TLVVGASYVALECAGFLAGIGLGVTVMVRSILLRGfDQDMANKIGEHMEEHGIKFIRQFVPIKVEQI..E
                                  220                  230                  240                  250                  260                  270

A) 1 sp|P09625|TRXB_ECOLI        MG..VTGVRLRDTQNSDNIES.L.....DVAGLFVAIGHSPNTAIFEG.QL.EL.E.NGYIKVQSGIH....
B) 2 sp|P80880|TRXB_BACSU        GK..VGNVTLVDTVTGEESE-.F.....KTDGVFIYIGMLPLSKPFENIGI.TN.E.EGYIET-------....
C) 3 sp|P46843|TRXB_MYCLE        TT..VTGLRLRNTTGEE--TT.L.....VVTGVFVAIGHEPRSSLVSD.VV.DI.DpDGYVLVK----....
D) 4 sp|P51978|TRXB_NEUCR        KG..LMSHLVVKDVTTGKEET.L.....EANGLFYAIGHDPATALVKG.QL.ET.DaDGYVVTKPG--....
E) 5 sp|P29509|TRB1_YEAST        KL..LNALRIKNTKKNEETD-.L.....PVSGLFYAIGHTPATKIVAG.QV.DTdE.AGYIKTVPG--....
F) 6 sp|P38816|TRB2_YEAST        KL..LNMLRIKNTKS--NVENdL.....EVNGLFYAIGHTPATKIVKG.QVdEE.E.TGYIKTVPG--....
G) 7 sp|Q39243|TRB1_ARATH        DV..LGGLKVKNVVTGD-VSD.L.....KVSGLFFAIGHEPATKFLDG.GV.EL.DsDGYVVTKPG--....
H) 8 sp|Q39242|TRB2_ARATH        NGrvLGGLKVKNVVTGD-VSD.L.....KVSGLFFAIGHEPATKFLDG.QL.ElDE.DGYVVTKPG--....
I) 9 sp|Q16881|TRXB_HUMAN        AG..TPG-RLRVVAQSTNSEE.IiegEYNTVMLAIGRDACTR----KI.GL.E.TVGVKINEKTGkipv....
```

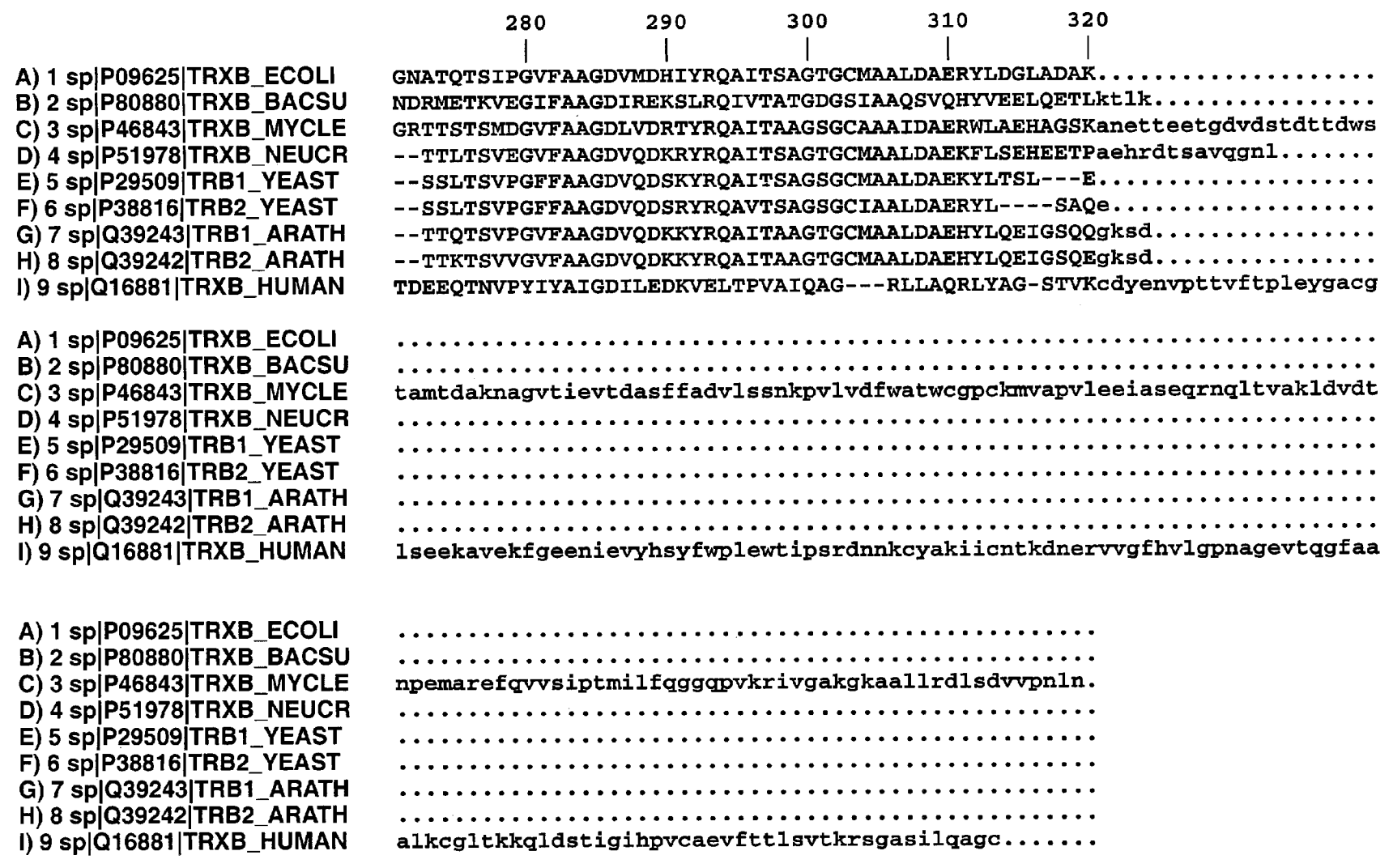

NUCLEIC ACIDS AND PROTEINS WITH THIOREDOXIN REDUCTASE ACTIVITY

This application claims the benefit of the filing date of U.S. Ser. No. 60/289,029, filed May 4, 2001, U.S. Ser. No. 60/370,609, filed Apr. 5, 2002, and the provisional application by Desjarlais and Muchhal, entitled "Novel Nucleic Acids and Proteins with Thioredoxin Reductase Activity", filed Apr. 29, 2002, Ser. No. 60/376,682.

SEQUENCE LISTING

The Sequence Listing submitted on compact disc is hereby incorporated by reference. The two identical compact discs contain the file named A71457-2.ST25.txt, created on Oct. 15, 2002, and containing 676,061 bytes.

FIELD OF THE INVENTION

The present invention relates to the use of a variety of methods for generating functional thioredoxin reductase variants in which at least one physical, chemical or biological property of the variant is altered in a specific and desired manner when compared to the wild-type protein.

BACKGROUND OF THE INVENTION

Thioredoxin, a small dithiol protein, is a specific reductant for major food proteins, allergenic proteins and particularly allergenic proteins present in widely used foods from animal and plant sources. Most proteins having disulfide (S—S) bonds are reduced to the sulfhydryl (SH) level by thioredoxin. These proteins are allergenically active and less digestible in the oxidized (S—S) state. When reduced (SH state), they lose their allergenicity and/or become more digestible. Of importance is the thioredoxin reduction of disulfide bonds in proteins such as albumins, globulins, gliadins, thionins, and the glutenins found in many seeds and cereals, and also a number of proteins found in milk. See, for example, Kiss, F. et al. (1991), *Arch. Biochem. Biophys.* 287:337–340; Johnson, T. C. et al. (1987), *Plant Physiol.* 85:446–451; Kasarda D. D. et al. (1976), *Adv. Cer. Sci. Tech.* 1:158–236; and Osborne T. B. et al. (1893), *Amer. Chem. J.* 15:392–471; Shewry, P. R. et al. (1985), *Adv. Cer. Sci. Tech.* 7:1–83; Dahle, L. K. et al. (1966), *Cereal Chem.* 43:682–688; Garcia-Olmedo, F. et al. (1987), Oxford *Surveys of Plant Molecular and Cell Biology* 4:275–335; Birk, Y. (1976), *Meth. Enzymol.* 45:695–739, and Laskowski, M., Jr. et al. (1980), *Ann. Reo. Biochem.* 49:593–626; Weselake, R. J. et al. (1983), *Plant Physiol.* 72:809–812; Birk, Y. (1985), *Int. J. Peptide Protein Res.* 25:113–131, and Birk, Y. (1976), *Meth. Enzymol.* 45:695–739; Birk, Y. (1985), *Int. J. Peptide Protein Res.* 25:113–131.

In addition, thioredoxin reduces the disulfide bonds in many toxic proteins, such as those found in snakes (Yang, C. C. (1967) *Biochim. Biophys. Acta.* 133:346–355; Howard, B. D. et al. (1977) *Biochemistry* 16:122–125), bees, scorpions (Watt, D. D. et al. (1972) *Toxicon* 10:173–181), the bacterial neurotoxins tetanus and botulinum (Schiavo, G. et al. (1990) *Infection and Immunity* 58:4136–4141; Kistner, A. et al. (1992) *Naunyn-Schmiedeberg's Arch Pharmacol* 345: 227–234), and thereby reduces or in some instances eliminates their toxicity altogether.

Thioredoxin achieves this reduction when activated (reduced) either by nicotinamide adenine dinucleotide phosphate (NADPH) via NADP-thioredoxin reductase (physiological conditions) or by dithiothreitol, a chemical reductant. See, for example, U.S. Pat. No. 5,952,034, incorporated herein by references in its entirety. Skin tests and feeding experiments carried out with sensitized dogs have shown that treatment of the food with reduced thioredoxin prior to ingestion eliminates or decreases the allergenicity of the food. Studies have also shown increased digestion of food and food proteins by pepsin and trypsin following reduction by thioredoxin.

Thus, it would be deirable to develop an efficient, low cost method of using thioredoxin reductase to reduce the toxicity of toxic proteins, reduce the allergenicty of food, and increase the digestibility of food.

SUMMARY OF THE INVENTION

In accordance with the objects outlined above, the present invention provides a method for altering the cofactor specificity of thioredoxin reductase comprising imputing a set of coordinates for a thioredoxin reductase scaffold protein comprising amino acid positions; applying at least one protein design cycle, and generating a set of candidate variant proteins with altered cofactor dependency. Preferably, the scaffold protein is selected from the group of organisms consisting of *E. coli, Bacillus subtillis, Mycobacterium leprae, Sarccharomyces, Neurospora crassa, Arabidopsis,* and human.

In an additional aspect, the cofactor specificity of the variant TR protein is NADPH or NADH. Perferably, the cofactor specificity is switched to NADH. In addition, other TR variants are generated that preferentially bind NADPH compared to NADH, preferentially bind NADH compared to NADPH, bind both cofactors equally. In other embodiments, the catalytic efficiency for one or the other cofactors or both is altered.

In an additional aspect the variant TR proteins have amino acid substitutitons selected from the group of substitutions consisting of RA4W, RA5L, R A5M, R A5I, R A5F, R A5V, R A5Y, RA5A, RA5S, RA5C, RA5T, RA6T, R A6S, R A6Q, R A6G, and R A6N, RA6D, RA6M, and RA6E.

In an additional aspect, the present invention provides a method for altering the substrate specificity of TR protein comprising inputing a set of coordinates for a thioredoxin reductase scaffold protein comprising amino acid positions; applying at least one protein design cycle, and generating a set of candidate variant proteins with altered substrate specificity.

In an additional aspect, the present invention provides a method for altering the cofactor specificity of a target protein comprising inputing a set of coordinates for a thioredoxin reductase scaffold protein comprising amino acid positions; applying at least one protein design cycle, and generating a set of candidate variant proteins with altered cofactor specificity.

In an additional embodiment, the present invention provides a variant thioredoxin reductase (TR) protein comprising an isolated polypeptide molecule of Formula I $$S_1\text{-}A_1\text{-}A_2\text{-}S_2\text{-}A_3\text{-}A_4\text{-}A_5\text{-}S_3\text{-}A_6\text{-}S_4 \qquad (I)$$

wherein
  a) $S_1$ comprises a polypeptide sequence selected from the group consisting of SEQ ID NO:1, SEQ ID NO:2, SEQ ID NO:3, SEQ ID NO:4, SEQ ID NO:5, SEQ ID NO:6, and SEQ ID NO:7, or a sequence having substantial similarity thereto;
  b) $S_2$ comprises a polypeptide sequence selected from the group consisting of SEQ ID NO:8, SEQ ID NO:9, SEQ ID NO:10, SEQ ID NO:11, SEQ ID NO:12, SEQ ID NO:13, and SEQ ID NO:14, or a sequence having substantial similarity thereto;

c) $S_3$ comprises a polypeptide sequence selected from the group consisting of SEQ ID NO:15, SEQ ID NO:16, SEQ ID NO:17, SEQ ID NO:18, SEQ ID NO:19, SEQ ID NO:20, and SEQ ID NO:21, or a sequence having substantial similarity thereto;

d) $S_4$ comprises a polypeptide sequence selected from the group consisting of SEQ ID NO:22, SEQ ID NO:23, SEQ ID NO:24, SEQ ID NO:25, SEQ ID NO:26, SEQ ID NO:27, and SEQ ID NO:28, or a sequence having substantial similarity thereto;

e) $A_1$ is an amino acid moiety selected from the group consisting of serine, valine, glycine, alanine, leucine, isoleucine, methionine, phenylalanine, and tryptophan;

f) $A_2$ is an amino acid moiety selected from the group consisting of alanine, glycine, valine, leucine, isoleucine, methionine, phenylalanine, and tryptophan;

g) $A_3$ is an amino acid moiety selected from the group consisting of histidine, aspartic acid, glutamic acid, arginine, leucine, serine, threonine, cysteine, asparagine, glutamine, and tyrosine;

h) $A_4$ is an amino acid moiety selected from the group consisting of arginine, alanine, glycine, valine, leucine, isoleucine, methionine, phenylalanine, and tryptophan;

i) $A_5$ is an amino acid moiety selected from the group consisting of arginine, asparagine, glutamine, aspartic acid, glutamic acid, cysteine, serine, threonine, and lysine;

j) $A_6$ is an amino acid moiety selected from the group consisting of arginine, glutamic acid, asparagine, glutamine, aspartic acid, cysteine, serine, threonine, and lysine;

provided that at least $A_1$ is not serine;

$A_2$ is not alanine;

$A_3$ is not histidine;

$A_4$ is not arginine;

$A_5$ is not arginine; or $A_6$ is not arginine.

In an additional aspect, the present invention provides a method for altering the oil content of plant cells comprising introducing an expression cassette comprising a promoter functional in a plant cell operably linked to a DNA molecule encoding a modified thioreduxin reductase (TR) protein comprising an amino terminal chloroplast transit peptide, into the cells of a plant so as to yield transformed plant cells; and regenerating said transformed plant cells to provide a differentiated transformed plant, wherein expression of the DNA molecule encoding the modified TR protein in said plant alters the co-factor specificity compared to the untransformed plant.

BRIEF DESCRIPTION OF THE DRAWINGS

FIG. 1 depicts the reaction catalyzed by thioredoxin reductases.

FIG. 2 depicts the active site pocket of reductases from a number of species is highly conserved. FIG. 2A lists some of the most common TR sequences. The first column lists the Genbank ID number, A1 through A6 refers to the amino acids defined in Formula I (described below), S2 and S3 are sequence domains separating A1 through A6 and are also defined in Formula I.

FIG. 2B lists some of the common glutathione reductase sequences.

FIGS. 2C and 2D represent the natural sequence diversity at each of the defined positions grouped according to organism.

FIG. 2E lists known cofactor specificity and known amino acid placement.

FIGS. 3A to 3BB (SEQ ID NOS:1–28) depict various sequences that may be used in Formula I.

FIG. 4 provides an overview of the high throughput TR screening methods.

FIG. 5 depicts protein purification strategies.

FIG. 6 depicts the kinetics of *Arabidopsis* NTR wild-type reductase with NAD(P)H.

FIG. 7 depicts variants obtained from the NTR-1 Library 1.

FIG. 8 depicts variants obtained from the NTR-1 Library 2.

FIGS. 9A and 9B depict the designed positions and the docked co-factor from NTR-1 Library 1 and NTR-1 Library 2.

FIG. 10 depicts the summary of results from the screening of variants from 4 computational libraries.

FIGS. 11A-1, 11A-2 and 11B depict the kinetic parameters for 2 variants versus wild-type TR.

FIG. 12 depicts a summary of the best variants obtained from the NTR-1 library 2 design.

FIGS. 13A and B summarize the activity of variants obtained from a high complexity random RRR library. A summary of the variants obtained from this library is found in FIG. 13C.

FIG. 14 depicts a computational model for two of the clones.

FIG. 15 summaries the enzymatic activities and kinetic parameters for some of the variants.

FIGS. 16A-1 through 16A-3 (SEQ ID NO:29) depict the nucleic acid sequence for the WVR variant.

FIGS. 16B-1 through 16B-3 (SEQ ID NO:30) depict the nucleic acid sequence for the WMG variant.

FIGS. 16C-1 through 16C-3 (SEQ ID NO:31) depict the nucleic acid sequence for the WIS variant.

FIGS. 16D-1 through 16D-3 (SEQ ID NO:32) depict the nucleic acid sequence for the WMS variant.

FIGS. 16E-1 through 16E-3 (SEQ ID NO:33) depict the nucleic acid sequence for the WLS variant.

FIGS. 16F-1 through 16F-3 (SEQ ID NO:34) depict the nucleic acid sequence for the WRT vanant.

FIGS. 16G-1 through 16G-3 (SEQ ID NO:35) depict the nucleic acid sequence for the RYN variant.

FIGS. 16H-1 through 16H-3 (SEQ ID NO:36) depict the nucleic acid sequence for the RYN-A variant.

FIGS. 16I-1 through 16I-3 (SEQ ID NO:37) depict the nucleic acid sequence for the RFN variant.

FIGS. 16J-1 through 16J-3 (SEQ ID NO:38) depict the RRR-WT nucleic acid sequence.

FIGS. 16K-1 through 16K-3 (SEQ ID NO:39) depict the nucleic acid sequence for the WVG variant.

FIGS. 16L-1 through 16L-3 (SEQ ID NO:40) depict the nucleic acid sequence for the WRS variant.

FIGS. 16M-1 through 16M-3 (SEQ ID NO:41) depict the nucleic acid sequence for the WFQ variant.

FIGS. 16N-1 through 16N-3 (SEQ ID NO:42) depict the nucleic acid sequence for the NTR wild-type protein.

FIGS. 16O-1 through 16O-3 (SEQ ID NO:43) depict the nucleic acid sequence for the RYN-M variant.

FIGS. 16P-1 through 16P-3 (SEQ ID NO:44) depict the nucleic acid sequence for the RYN-L variant.

FIGS. 16Q-1 through 16Q-3 (SEQ ID NO:45) depict the nucleic acid sequence for the RYN-I variant.

FIGS. 16R-1 through 16R-3 (SEQ ID NO:46) depict the nucleic acid sequence for the RYN-A variant.

FIGS. 17A-1 through 17A-2 (SEQ ID NOS:47–60) and 17B-1 through 17B-2 (SEQ ID NOS:61–64) depict the alignment of the *Arabidopsis* NTR wild-type protein with several of the variants.

FIG. 18 is a computational representation of the critical RRR to RYN change described in Example 1.

FIG. 19 depicts a small sample of NAD conformations culled from the protein databank. The ball-and-stick model is the NAD_TDF conformer, which has a different ribose pucker than most of the others.

FIG. 20 depicts the library postions utilized in PDA simulations and generation of libraries 1 and 2.

FIGS. 21A through 21K (SEQ ID NOS:65–75) depict the amino acid sequences of several wild-type TR proteins. Sequences correspond to the following: A) |P09625|TRXB_ECOLI (SEQ ID NO:65); B) |P80880|TRXB_BACSU (SEQ ID NO:66); C) |P46843|TRXB_MYCLE (SEQ ID NO:67); D) |P51978|TRXB_NEUCR (SEQ ID NO:68);E) |P29509|TRB1_YEAST (SEQ ID NO:69); F) |P38816|TRB2_YEAST (SEQ ID NO:70); G) |Q39243|TRB1_ARATH (SEQ ID NO:71); H) |Q39242|TRB2_ARATH (SEQ ID NO:72); I) |Q16881|TRXB_HUMAN (SEQ ID NO:73); J) |gi|1592167|TRXB_Methanococcus jannaschii (SEQ ID NO:74); and K) |gi|2649006|TRXB_Amhaeoglobus fulgidus (SEQ ID NO:75).

FIGS. 22A through 22C (SEQ ID NO:65–73) depict the sequence alignment of several wild-type TR proteins. Sequences correspond to the following: A) |P09625|TRXB_ECOLI (SEQ ID NO:65); B) |P80880|TRXB_BACSU (SEQ ID NO:66); C) |P46843|TRXB_MYCLE (SEQ ID NO:67); D) |P51978|TRXB_NEUCR (SEQ ID NO:68); E) |P29509|TRB1_YEAST (SEQ ID NO:69); F) |P38816|TRB2_YEAST (SEQ ID NO:70); G) |Q39243|TRB1_ARATH (SEQ ID NO:71); H) |Q39242|TRB2_ARATH (SEQ ID NO:72); and, I) |Q16881|TRXB_HUMAN (SEQ ID NO:73).

DETAILED DESCRIPTION OF THE INVENTION

The present invention is directed to the generation of variant proteins and nucleic acids that exhibit altered cofactor specificity. The variant proteins may be generated using a number of different approaches, such as conventional mutagenesis approaches and computational processing approaches. Computational processing approaches have been previously described in U.S. Pat. Nos. 6,188,965 and 6,296,312, U.S. Ser. Nos. 09/419,351, 09/782,004, 09/927, 79, and 09/877,695; all of which are expressly incorporated herein by reference in their entirety. In general, these applications describe a variety of computational modeling systems that allow the generation of extremely stable proteins. In this way, variants of wild-type proteins are generated that exhibit altered cofactor specificity as compared to wild-type proteins.

The methods of the present invention can be applied to any enzyme that exhibits a preference for one cofactor over another. For example, enzyme reductases often exhibit a preference for one cofactor versus another. In addition, the methods of the present invention can be applied to change the substrate specificity of a target protein.

In particular, the methods of the present invention can be used to change the cofactor preference from NADPH to NADH. NADPH is an expensive reductant. Its expense has prohibited the wide use of thioredoxin systems in reducing food allergens and venom treatments. Thus, there is a need in the art to find other systems that achieve the same results as the use of NADP-thioredoxin reductase reductants but at lower costs. One such system, would be to generate variants of thioredoxin reductase with altered cofactor specificity.

According the present invention provides methods for altering the cofactor specificity of a target protein. By "altering" herein or grammatical equivalents thereof in the context of a polypeptide, as used herein, further refers to any characteristic or attribute of a polypeptide that can be selected or detected and compared to the corresponding property of a naturally occurring protein. These properties include, but are not limited to cofactor specificity, cytotoxic activity; oxidative stability, substrate specificity, substrate binding or catalytic activity, thermal stability, alkaline stability, pH activity profile, resistance to proteolytic degradation, kinetic association ($K_{on}$) and dissociation ($K_{off}$) rate, protein folding, inducing an immune response, ability to bind to a ligand, ability to bind to a receptor, ability to be secreted, ability to be displayed on the surface of a cell, ability to oligomerize, ability to signal, ability to stimulate cell proliferation, ability to inhibit cell proliferation, ability to induce apoptosis, ability to be modified by phosphorylation or glycosylation, ability to treat disease.

Unless otherwise specified, a substantial change in any of the above-listed properties, when comparing the property of a variant polypeptide of the present invention to the property of a target protein or wild-type protein is preferably at least a 20%, more preferably, 50%, more preferably at least a 2-fold increase or decrease.

By "cofactor specificity" herein is meant changing the cofactor preference of an enzyme. By "cofactor" herein is meant coenzymes, such as NADPH, NADH, that participate in oxidation/reduction reactions. Thus, if a target protein exhibits a preference for one cofactor over another, the methods of the present invention may be used to alter the cofactor preference of the target enzyme, such that the preference for the less favored cofactor is increased by 20%, 50%, 100%, 300%, 500%, 1000%, up to 2000%. For example, a number of reductase enzymes favor NADPH over NADH (see WO 02/22526; WO 02.29019; Mittl, P R., et al., (1994) Protein Sci., 3: 1504–14; Banta, S., et al., (2002) Protein Eng., 15:131–140; all of which are hereby incorporated by reference in their entirety). As the availability of NADPH is often limiting, both in vivo and in vitro, the overall activity of target protein is often limited. For target proteins that prefer NADPH as a cofactor, it would be desirable to alter the cofactor specificity of the target protein to a cofactor that is more readily available, such as NADH.

In a preferred embodiment, the cofactor specificity of the target protein is switched. By "switched" herein is meant, that the cofactor preference (e.g. affinity) of a target protein is changed to another cofactor. Preferably, in one embodiment, by switching cofactor specificity, activity with the cofactor preferred by the wild-type enzyme is reduced, while the activity with the less preferred cofactor is increased. For example, if a target protein prefers NADPH, switching the preference to NADH would result in the variant TR having at least 50% of native NADPH dependent activity using NADH. More preferably, the variant TRs wil have at least 75% of native NADPH dependent activity using NADH, More preferably the variant TRs will have 85%, 95%, up to 100% of native NADPH activity using NADH. Alternatively, in another embodiment, the alternate cofactor affinity is increased without a decrease in preferred cofactor affinity. In yet other embodiments, the cofactor affinity for both factors is changed simultaneously.

In a preferred, the catalytic efficiency of the target protein for a cofactor is enhanced. By "catalytic efficiency" herein is meant the activity with the cofactor is significantly improved. Catalytic efficiency may be improved for either the preferred cofactor or, in those embodiments where the cofactor specificity is altered the catalytic efficiency with the altered cofactor may be improved.

In a preferred embodiment, the binding affinity of the target protein for a cofactor is enhanced. A change in binding affinity is evidenced by at least a 5% or greater increase or decrease in binding affinity compared to the wild-type target protein. In certain embodiments, variant proteins of the present invention may show greater than 100 times more affinity for one cofactor than for another, while in other embodiments the variant protein may show greater than 50 times more affinity for one cofactor than for another, or the variant protein may show greater than 25 times more affinity for one cofactor than another.

In a preferred embodiment, the substrate specificity of the target protein is altered. For example, if a target protein typically acts on a substrate from the same species, the substrate specificity of the target protein may be changed such that the variant protein acts on substrates from other species. Accordingly, the present invention is directed to methods for altering the cofactor specificity of target protein. By "target protein" or "scaffold protein" or grammatical equivalents herein is meant at least two covalently attached amino acids, which includes proteins, polypeptides, oligopeptides and peptides. The protein may be made up of naturally occurring amino acids and peptide bonds, or synthetic peptidomimetic structures, i.e., "analogs" such as peptoids [see Simon et al., Proc. Natl. Acd. Sci. U.S.A. 89(20:9367–71 (1992)], generally depending on the method of synthesis. Thus "amino acid", or "peptide residue", as used herein means both naturally occurring and synthetic amino acids. For example, homo-phenylalanine, citrulline, and norleucine are considered amino acids for the purposes of the invention. "Amino acid" also includes imino acid residues such as proline and hydroxyproline. In addition, any amino acid representing a component of the variant proteins of the present invention can be replaced by the same amino acid but of the opposite chirality. Thus, any amino acid naturally occurring in the L-configuration (which may also be referred to as the R or S, depending upon the structure of the chemical entity) may be replaced with an amino acid of the same chemical structural type, but of the opposite chirality, generally referred to as the D-amino acid but which can additionally be referred to as the R— or the S—, depending upon its composition and chemical configuration. Such derivatives have the property of greatly increased stability, and therefore are advantageous in the formulation of compounds which may have longer in vivo half lives, when administered by oral, intravenous, intramuscular, intraperitoneal, topical, rectal, intraocular, or other routes. In the preferred embodiment, the amino acids are in the (S) or L-configuration. If non-naturally occurring side chains are used, non-amino acid substituents may be used, for example to prevent or retard in vivo degradations. Proteins including non-naturally occurring amino acids may be synthesized or in some cases, made recombinantly; see van Hest et al., FEBS Lett 428:(1–2) 68–70 May 22, 1998 and Tang et al., Abstr. Pap Am. Chem. S218:U138-U138 Part 2 Aug. 22, 1999, both of which are expressly incorporated by reference herein.

Aromatic amino acids may be replaced with D- or L-naphylalanine, D- or L-Phenylglycine, D- or L-2-thieneylalanine, D- or L-1-, 2-, 3- or 4-pyreneylalanine, D- or L-3-thieneylalanine, D- or L-(2-pyridinyl)-alanine, D- or L-(3-pyridinyl)-alanine, D- or L-(2-pyrazinyl)-alanine, D- or L-(4-isopropyl)-phenylglycine, D-(trifluoromethyl)-phenylglycine, D-(trifluoromethyl)-phenylalanine, D-p-fluorophenylalanine, D- or L-p-biphenylphenylalanine, D- or L-p-methoxybiphenylphenylalanine, D- or L-2-indole (alkyl)alanines, and D- or L-alkylainines where alkyl may be substituted or unsubstituted methyl, ethyl, propyl, hexyl, butyl, pentyl, isopropyl, iso-butyl, sec-isotyl, iso-pentyl, non-acidic amino acids, of C1–C20. Acidic amino acids can be substituted with non-carboxylate amino acids while maintaining a negative charge, and derivatives or analogs thereof, such as the non-limiting examples of (phosphono) alanine, glycine, leucine, isoleucine, threonine, or serine; or sulfated (e.g., —SO.sub.3 H) threonine, serine, tyrosine. Other substitutions may include unnatural hyroxylated amino acids may made by combining "alkyl" with any natural amino acid. The term "alkyl" as used herein refers to a branched or unbranched saturated hydrocarbon group of 1 to 24 carbon atoms, such as methyl, ethyl, n-propyl, isoptopyl, n-butyl, isobutyl, t-butyl, octyl, decyl, tetradecyl, hexadecyl, eicosyl, tetracisyl and the like. Alkyl includes heteroalkyl, with atoms of nitrogen, oxygen and sulfur. Preferred alkyl groups herein contain 1 to 12 carbon atoms. Basic amino acids may be substituted with alkyl groups at any position of the naturally occurring amino acids lysine, arginine, ornithine, citrulline, or (guanidino)-acetic acid, or other (guanidino)alkyl-acetic acids, where "alkyl" is define as above. Nitrile derivatives (e.g., containing the CN-moiety in place of COOH) may also be substituted for asparagine or glutamine, and methionine sulfoxide may be substituted for methionine. Methods of preparation of such peptide derivatives are well known to one skilled in the art.

In addition, any amide linkage in any of the variant polypeptides can be replaced by a ketomethylene moiety. Such derivatives are expected to have the property of increased stability to degradation by enzymes, and therefore possess advantages for the formulation of compounds which may have increased in vivo half lives, as administered by oral, intravenous, intramuscular, intraperitoneal, topical, rectal, intraocular, or other routes. Additional amino acid modifications of amino acids of variant polypeptides of to the present invention may include the following: Cysteinyl residues may be reacted with alpha-haloacetates (and corresponding amines), such as 2-chloroacetic acid or chloroacetamide, to give carboxymethyl or carboxyamidomethyl derivatives. Cysteinyl residues may also be derivatized by reaction with compounds such as bromotrifluoroacetone, alpha-bromo-beta-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole. Histidyl residues may be derivatized by reaction with compounds such as diethylprocarbonate e.g., at pH 5.5–7.0 because this agent is relatively specific for the histidyl side chain, and para-bromophenacyl bromide may also be used; e.g., where the reaction is preferably performed in 0.1M sodium cacodylate at pH 6.0. Lysinyl and amino terminal residues may be reacted with compounds such as succinic or other carboxylic acid anhydrides. Derivatization with these agents is expected to have the effect of reversing the charge of the lysinyl residues. Other suitable reagents for derivatizing alpha-amino-containing residues include compounds such as imidoesters/e.g., as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate. Arginyl residues may be modified by reaction with one or several conventional reagents, among them phenylglyoxal, 2,3-butanedione, 1,2-cyclohexanedione, and ninhydrin according to known method steps. Derivatization of arginine residues requires that the reaction be performed in alkaline conditions because of the high pKa of the guanidine functional group. Furthermore, these reagents may react with the groups of lysine as well as the arginine epsilon-amino group. The specific modification of tyrosyl residues per se is well-known, such as for introducing spectral labels into tyrosyl residues by reaction with aromatic diazonium compounds or tetranitromethane. N-acetylimidizol and tetranitromethane may be used to form O-acetyl tyrosyl species and 3-nitro derivatives, respectively. Carboxyl side groups (aspartyl or glutamyl) may be selectively modified by reaction with carbodiimides (R'—N═C═N—R') such as 1-cyclohexyl-3-(2-morpholinyl-(4-ethyl) carbodiimide or 1-ethyl-3-(4-azonia4,4-dimethylpentyl) carbodiimide.

Furthermore aspartyl and glutamyl residues may be converted to asparaginyl and glutaminyl residues by reaction with ammonium ions. Glutaminyl and asparaginyl residues may be frequently deamidated to the corresponding glutamyl and aspartyl residues. Alternatively, these residues may be deamidated under mildly acidic conditions. Either form of these residues falls within the scope of the present invention.

The target or scaffold protein may be any protein for which a three dimensional structure is known or can be generated; that is, for which there are three dimensional coordinates for each atom of the protein. Generally this can be determined using X-ray crystallographic techniques, NMR techniques, de novo modeling, homology modeling, etc. In general, if X-ray structures are used, structures at 2 resolution or better are preferred, but not required.

The target or scaffold proteins of the present invention may be from prokaryotes and eukaryotes, such as bacteria (including extremeophiles such as the archebacteria), fungi, insects, fish, plants, and mammals. Suitable mammals include, but are not limited to, rodents (rats, mice, hamsters, guinea pigs, etc.), primates, farm animals (including sheep, goats, pigs, cows, horses, etc) and in the most preferred embodiment, from humans.

Thus, by "target protein" or "scaffold protein" herein is meant a protein for which a variant protein or a library of variant proteins, preferably with altered cofactor specificity is desired. As will be appreciated by those in the art, any number of target proteins find use in the present invention. Specifically included within the definition of "protein" are fragments and domains of known proteins, including functional domains such as enzymatic domains, binding domains, etc., and smaller fragments, such as turns, loops, etc. That is, portions of proteins may be used as well. In addition, "protein" as used herein includes proteins, oligopeptides and peptides. In addition, protein variants, i.e. non-naturally occurring protein analog structures, may be used.

Suitable proteins include, but are not limited to, industrial, pharmaceutical, and agricultural proteins. Suitable classes of enzymes include, but are not limited to, reductases, hydrolases such as proteases, carbohydrases, lipases; isomerases such as racemases, epimerases, tautomerases, or mutases; transferases, kinases, oxidoreductases, dehydrogenases, and phophatases. Suitable enzymes are listed in the Swiss-Prot enzyme database. Suitable protein backbones include, but are not limited to, all of those found in the protein data base compiled and serviced by the Research Collaboratory for Structural Bioinformatics (RCSB, formerly the Brookhaven National Lab).

Specifically, preferred target protein include reductases, such as thioredoxin reductase (US Pub. No. 2002/0037303), 2,5-diketo-D-gluconic acid reductase (Banta, S, et al., (2002) *Protein Eng.*, 15: 131–140; WO 02/22527; WO 02/29019), glutathione reductase (Mittl, P R, et al. (1993) *J. Mol. Biol.*, 231: 191–5; Mittl & Schulz, (1994) *Protein Sci.*, 3: 799–809; Mittl, P R, et al., (1994) *Protein Sci.*, 3: 1504–14), the alkyl hydroperoxide reductase system (Wood, Z A, et al., (2001), *Biochemistry*, 40: 3900–3911), thioredoxin reductase-like proteins (Reynolds, C M, et al., (2002) *Biochemistry*, 41: 1990–2001)

Accordingly, the present invention is directed to computational processing methods for altering the cofactor specificity of the target protein. Once a set of coordinates for a target protein or scaffold protein is imported, a protein design cycle is implemented to generate a set of variable protein sequences with altered affinity for a desired receptor. By "protein design cycle" herein is meant any one of a number of protein design algorithms that can be used to produce a sequence or sequence including but not limited to Protein Design Automation™ (PDA™), sequence prediction algorithm (SPA), various force field calculations, etc. See U.S. Pat. Nos. 6,188,965 and 6,296,312, U.S. Ser. Nos. 09/419,351, 09/782,004, 09/927,79 09/877,695; Raha, K., et al. (2000) *Protein Sci.*, 9:1106–1119, U.S. Ser. No. 09/877,695, filed Jun. 8, 2001, entitled "Apparatus and Method for Designing Proteins and Protein Libraries; U.S. Ser. Nos. 09/927,790, 60/352,103, and 60/351,937, all of which are expressly incorporated herein by reference in their entirety.

In a preferred embodiment, the methods of the invention involve starting with a target protein and use computational processing to generate a candidate or variant protein or a set of primary sequences. In a preferred embodiment, sequence based methods are used. Alternatively, structure based methods, such as PDA™, described in detail below, are used. Other models for assessing the relative energies of sequences with high precision include Warshel, *Computer Modeling of Chemical Reactions in Enzymes and Solutions*, Wiley & Sons, New York, (1991), hereby expressly incorporated by reference.

Similarly, molecular dynamics calculations can be used to computationally screen sequences by individually calculating mutant sequence scores and compiling a rank ordered list.

In a preferred embodiment, residue pair potentials can be used to score sequences (Miyazawa et al., Macromolecules 18(3):534–552 (1985), expressly incorporated by reference) during computational screening.

In a preferred embodiment, sequence profile scores (Bowie et al., Science 253(5016):164–70 (1991), incorporated by reference) and/or potentials of mean force (Hendlich et al., J. Mol. Biol. 216(1):167–180 (1990), also incorporated by reference) can also be calculated to score sequences. These methods assess the match between a sequence and a 3D protein structure and hence can act to screen for fidelity to the protein structure. By using different scoring functions to rank sequences, different regions of sequence space can be sampled in the computational screen.

Furthermore, scoring functions can be used to screen for sequences that would create metal or co-factor binding sites in the protein (Hellinga, Fold Des. 3(1): R1–8 (1998), hereby expressly incorporated by reference). Similarly, scoring functions can be used to screen for sequences that would create disulfide bonds in the protein. These potentials attempt to specifically modify a protein structure to introduce a new structural motif.

In a preferred embodiment, sequence and/or structural alignment programs can be used to generate the variant proteins of the invention. As is known in the art, there are a number of sequence-based alignment programs; including for example, Smith-Waterman searches, Needleman-Wunsch, Double Affine Smith-Waterman, frame search, Gribskov/GCG profile search, Gribskov/GCG profile scan, profile frame search, Bucher generalized profiles, Hidden Markov models, Hframe, Double Frame, Blast, Psi-Blast, Clustal, and GeneWise.

The source of the sequences can vary widely, and include taking sequences from one or more of the known databases, including, but not limited to, SCOP (Hubbard, et al., Nucleic Acids Res 27(1):254–256. (1999)); PFAM (Bateman, et al., Nucleic Acids Res 27(1):260–262. (1999)); VAST (Gibrat, et al., Curr Opin Struct Biol 6(3):377–385. (1996)); CATH (Orengo, et al., Structure 5(8):1093–1108. (1997)); PhD Predictor (http://www.embl-heidelberg.de/predictprotein/predictprotein.html); Prosite (Hofmann, et al., Nucleic Acids Res 27(1):215–219. (1999)); PIR (http://www.mips.biochem.mpg.de/proj/protseqdb/); GenBank (http://www.ncbi.nlm.nih.gov/); PDB (www.rcsb.org) and BIND (Bader, et al., Nucleic Acids Res 29(1):242–245. (2001)). In addition, sequences from these databases can be subjected to contiguous analysis or gene prediction; see Wheeler, et al., Nucleic Acids Res 28(1):10–14. (2000) and Burge and Karlin, J Mol Biol 268(1):78–94. (1997).

As is known in the art, there are a number of sequence alignment methodologies that can be used. For example, sequence homology based alignment methods can be used to create sequence alignments of proteins related to the target structure (Altschul et al., J. Mol. Biol. 215(3):403–410 (1990), Altschul et al., Nucleic Acids Res. 25:3389–3402 (1997), both incorporated by reference). These sequence alignments are then examined to determine the observed sequence variations. These sequence variations are tabulated to define a set of variant proteins.

Sequence based alignments can be used in a variety of ways. For example, a number of related proteins can be aligned, as is known in the art, and the "variable" and "conserved" residues defined; that is, the residues that vary or remain identical between the family members can be defined. These results can be used to generate a probability table, as outlined below. Similarly, these sequence variations can be tabulated and a secondary library defined from them as defined below. Alternatively, the allowed sequence variations can be used to define the amino acids considered at each position during the computational screening. Another variation is to bias the score for amino acids that occur in the sequence alignment, thereby increasing the likelihood that they are found during computational screening but still allowing consideration of other amino acids. This bias would result in a focused library of variant proteins but would not eliminate from consideration amino acids not found in the alignment. In addition, a number of other types of bias may be introduced. For example, diversity may be forced; that is, a "conserved" residue is chosen and altered to force diversity on the protein and thus sample a greater portion of the sequence space. Alternatively, the positions of high variability between family members (i.e. low conservation) can be randomized, either using all or a subset of amino acids. Similarly, outlier residues, either positional outliers or side chain outliers, may be eliminated.

Similarly, structural alignment of structurally related proteins can be done to generate sequence alignments. There are a wide variety of such structural alignment programs known. See for example VAST from the NCBI (http://www.ncbi.nlm.nih.gov:80/Structure/VAST/vast.shtml); SSAP (Orengo and Taylor, Methods Enzymol 266(617–635 (1996)) SARF2 (Alexandrov, Protein Eng 9(9):727–732. (1996)) C E (Shindyalov and Bourne, Protein Eng 11(9):739–747. (1998)); (Orengo et al., Structure 5(8):1093–108 (1997); Dali (Holm et al., Nucleic Acid Res. 26(1):316–9 (1998), all of which are incorporated by reference). These sequence alignments can then be examined to determine the observed sequence variations. Libraries can be generated by predicting secondary structure from sequence, and then selecting sequences that are compatible with the predicted secondary structure. There are a number of secondary structure prediction methods such as helix-coil transition theory (Munoz and Serrano, Biopolymers 41:495, 1997), neural networks, local structure alignment and others (e.g., see in Selbig et al., Bioinformatics 15:1039–46, 1999).

Similarly, as outlined above, other computational methods are known, including, but not limited to, sequence profiling [Bowie and Eisenberg, Science 253(5016):164–70, (1991)], rotamer library selections [Dahiyat and Mayo, Protein Sci. 5(5):895–903 (1996); Dahiyat and Mayo, Science 278(5335):82–7 (1997); Desjarlais and Handel, Protein Science 4:2006–2018 (1995); Harbury et al, Proc. Natl. Acad. Sci. U.S.A. 92(18):8408–8412 (1995); Kono et al., Proteins: Structure, Function and Genetics 19:244–255 (1994); Hellinga and Richards, Proc. Natl. Acad. Sci. U.S.A. 91:5803–5807 (1994)]; and residue pair potentials [Jones, Protein Science 3: 567–574, (1994)]; PROSA [Heindlich et al., J. Mol. Biol. 216:167–180 (1990)]; THREADER [Jones et al., Nature 358:86–89 (1992)], and other inverse folding methods such as those described by Simons et al. [Proteins, 34:535–543, (1999)], Levitt and Gerstein [Proc. Natl. Acad. Sci. U.S.A., 95:5913–5920, (1998)], Godzik and Skolnick [Proc. Natl. Acad. Sci. U.S.A., 89:12098–102, (1992)], Godzik et al. [J. Mol. Biol. 227:227–38, (1992)] and two profile methods [Gribskov et al. Proc. Natl. Acad. Sci. U.S.A. 84:4355–4358 (1987) and Fischer and Eisenberg, Protein Sci. 5:947–955 (1996), Rice and Eisenberg J. Mol. Biol. 267:1026–1038(1997)], all of which are expressly incorporated by reference.

In addition, other computational methods such as those described by Koehl and Levitt (J. Mol. Biol. 293:1161–1181 (1999); J. Mol. Biol. 293:1183–1193 (1999); expressly incorporated by reference) can be used to create a variant library that can optionally then be used to generate a smaller secondary library for use in experimental screening for improved properties and function. In addition, there are computational methods based on force-field calculations such as SCMF that can be used as well for SCMF, see Delarue et al. Pac. Symp. Biocomput. 109–21 (1997); Koehl et al., J. Mol. Biol. 239:249–75 (1994); Koehl et al., Nat. Struct. Biol. 2:163–70 (1995); Koehl et al., Curr. Opin. Struct. Biol. 6:222–6 (1996); Koehl et al., J. Mol. Biol. 293:1183–93 (1999); Koehl et al., J. Mol. Biol. 293:1161–81 (1999); Lee J., Mol. Biol. 236:918–39 (1994); and Vasquez Biopolymers 36:53–70 (1995); all of which are expressly incorporated by reference. Other forcefield calculations that can be used to optimize the conformation of a sequence within a computational method, or to generate de novo optimized sequences as outlined herein include, but are not limited to, OPLS-AA [Jorgensen et al., J. Am. Chem. Soc. 118:11225–11236 (1996); Jorgensen, W. L.; BOSS, Version 4.1; Yale University: New Haven, Conn. (1999)]; OPLS [Jorgensen et al., J. Am. Chem. Soc. 110:1657ff (1988); Jorgensen et al., J Am. Chem. Soc. 112:4768ff (1990)]; UNRES (United Residue Forcefield; Liwo et al., Protein Science 2:1697–1714 (1993); Liwo et al., Protein Science 2:1715–1731 (1993); Liwo et al., J. Comp. Chem. 18:849–873 (1997); Liwo et al., J. Comp. Chem. 18:874–884 (1997); Liwo et al., J. Comp. Chem. 19:259–276 (1998); Forcefield for Protein Structure Prediction (Liwo et al., Proc. Natl. Acad. Sci. U.S.A. 96:5482–5485 (1999)]; ECEPP/3 [Liwo et al., J Protein Chem. 13(4):375–80 (1994)]; AMBER 1.1 force field (Weiner et al., J. Am. Chem. Soc. 106:765_784); AMBER 3.0 force field [U. C. Singh et al., Proc. Natl. Acad. Sci. U.S.A. 82:755–759 (1985)]; CHARMM and CHARMM22 (Brooks et al., J. Comp. Chem. 4:187–217); cvff3.0 [Dauber-Osguthorpe et al., Proteins: Structure, Function and Genetics, 4:31–47 (1988)]; cff91 (Maple et al., J. Comp. Chem. 15:162–182); also, the DISCOVER (cvff and cff91) and AMBER force-fields are used in the INSIGHT molecular modeling package (Biosym/MSI, San Diego Calif.) and HARMM is used in the QUANTA molecular modeling package (Biosym/MSI, San Diego Calif.), all of which are expressly incorporated by reference. In fact, as is outlined below, these force-field methods may be used to generate the variant TR library directly; these methods can be used to generate a probability table from which an additional library is directly generated.

In a preferred embodiment, Protein Design Automation™ (PDA™) is used to generate a variable protein sequence comprising a defined energy state for each amino acid position as is described in U.S. Pat. Nos. 6,188,965 and 6,296,312, all of which are expressly incorporated herein by reference. Briefly, PDA™ can be described as follows. A known protein structure is used as the starting point. The residues to be optimized are then identified, which may be the entire sequence or subset(s) thereof. The side chains of any positions to be varied are then removed. The resulting structure consisting of the protein backbone and the remaining sidechains is called the template. Each variable residue position is then preferably classified as a core residue, a surface residue, or a boundary residue; each classification defines a subset of possible amino acid residues for the position (for example, core residues generally will be selected from the set of hydrophobic residues, surface residues generally will be selected from the hydrophilic residues, and boundary residues may be either). Each amino acid can be represented by a discrete set of all allowed conformers of each side chain, called rotamers. Thus, to arrive at an optimal sequence for a backbone, all possible sequences of rotamers must be screened, where each backbone position can be occupied either by each amino acid in all its possible rotameric states, or a subset of amino acids, and thus a subset of rotamers.

Two sets of interactions are then calculated for each rotamer at every position: the interaction of the rotamer side chain with all or part of the backbone (the "singles" energy, also called the rotamer/template or rotamer/backbone energy), and the interaction of the rotamer side chain with all other possible rotamers at every other position or a subset of the other positions (the "doubles" energy, also called the rotamer/rotamer energy). The energy of each of these interactions is calculated through the use of a variety of scoring functions, which include the energy of van der Waal's forces, the energy of hydrogen bonding, the energy of secondary structure propensity, the energy of surface area solvation and the electrostatics. Thus, the total energy of each rotamer interaction, both with the backbone and other rotamers, is calculated, and stored in a matrix form.

The discrete nature of rotamer sets allows a simple calculation of the number of rotamer sequences to be tested. A backbone of length n with m possible rotamers per position will have $m^n$ possible rotamer sequences, a number which grows exponentially with sequence length and renders the calculations either unwieldy or impossible in real time. Accordingly, to solve this combinatorial search problem, a "Dead End Elimination" (DEE) calculation is performed. The DEE calculation is based on the fact that if the worst total interaction of a first rotamer is still better than the best total interaction of a second rotamer, then the second rotamer cannot be part of the global optimum solution. Since the energies of all rotamers have already been calculated, the DEE approach only requires sums over the sequence length to test and eliminate rotamers, which speeds up the calculations considerably. DEE can be rerun comparing pairs of rotamers, or combinations of rotamers, which will eventually result in the determination of a single sequence which represents the global optimum energy.

Once the global solution has been found, a Monte Carlo search may be done to generate a rank-ordered list of sequences in the neighborhood of the DEE solution. Starting at the DEE solution, random positions are changed to other rotamers, and the new sequence energy is calculated. If the new sequence meets the criteria for acceptance, it is used as a starting point for another jump. After a predetermined number of jumps, a rank-ordered list of sequences is generated. Monte Carlo searching is a sampling technique to explore sequence space around the global minimum or to find new local minima distant in sequence space. As is more additionally outlined below, there are other sampling techniques that can be used, including Boltzman sampling, genetic algorithm techniques and simulated annealing. In addition, for all the sampling techniques, the kinds of jumps allowed can be altered (e.g. random jumps to random residues, biased jumps (to or away from wild-type, for example), jumps to biased residues (to or away from similar residues, for example), etc.). Similarly, for all the sampling techniques, the acceptance criteria of whether a sampling jump is accepted can be altered.

As outlined in U.S. Ser. No. 09/127,926, the protein backbone (comprising (for a naturally occurring protein) the nitrogen, the carbonyl carbon, the α-carbon, and the carbonyl oxygen, along with the direction of the vector from the α-carbon to the β-carbon) may be altered prior to the computational analysis, by varying a set of parameters called supersecondary structure parameters.

Once a protein structure backbone is generated (with alterations, as outlined above) and input into the computer, explicit hydrogens are added if not included within the structure (for example, if the structure was generated by X-ray crystallography, hydrogens must be added). After hydrogen addition, energy minimization of the structure is run, to relax the hydrogens as well as the other atoms, bond angles and bond lengths. In a preferred embodiment, this is done by doing a number of steps of conjugate gradient minimization (Mayo et al., J. Phys. Chem. 94:8897 (1990)) of atomic coordinate positions to minimize the Dreiding force field with no electrostatics. Generally from about 10 to about 250 steps is preferred, with about 50 being most preferred.

The protein backbone structure contains at least one variable residue position. As is known in the art, the residues, or amino acids, of proteins are generally sequentially numbered starting with the N-terminus of the protein. Thus a protein having a methionine at it's N-terminus is said to have a methionine at residue or amino acid position 1, with the next residues as 2, 3, 4, etc. At each position, the wild type (i.e. naturally occurring) protein may have one of at least 20 amino acids, in any number of rotamers. By "variable residue position" herein is meant an amino acid position of the protein to be designed that is not fixed in the design method as a specific residue or rotamer, generally the wild-type residue or rotamer.

In a preferred embodiment, all of the residue positions of the protein are variable. That is, every amino acid side chain may be altered in the methods of the present invention. This is particularly desirable for smaller proteins, although the present methods allow the design of larger proteins as well. While there is no theoretical limit to the length of the protein that may be designed this way, there is a practical computational limit.

In an alternate preferred embodiment, only some of the residue positions of the protein are variable, and the remainder are "fixed", that is, they are identified in the three dimensional structure as being in a set conformation. In some embodiments, a fixed position is left in its original conformation (which may or may not correlate to a specific rotamer of the rotamer library being used). Alternatively, residues may be fixed as a non-wild type residue; for example, when known site-directed mutagenesis techniques have shown that a particular residue is desirable (for example, to eliminate a proteolytic site or alter the substrate specificity of an enzyme), the residue may be fixed as a particular amino acid. Alternatively, the methods of the present invention may be used to evaluate mutations de novo, as is discussed below. In an alternate preferred embodiment, a fixed position may be "floated"; the amino acid at that position is fixed, but different rotamers of that amino acid are tested. In this embodiment, the variable residues may be at least one, or anywhere from 0.1% to 99.9% of the total number of residues. Thus, for example, it may be possible to change only a few (or one) residues, or most of the residues, with all possibilities in between.

In a preferred embodiment, residues which can be fixed include, but are not limited to, structurally or biologically functional residues; alternatively, biologically functional residues may specifically not be fixed. For example, residues which are known to be important for biological activity, such as the residues which form the active site of an enzyme, the substrate binding site of an enzyme, the binding site for a binding partner (ligand/receptor, antigen/antibody, etc.), phosphorylation or glycosylation sites which are crucial to biological function, or structurally important residues, such as disulfide bridges, metal binding sites, critical hydrogen bonding residues, residues critical for backbone conformation such as proline or glycine, residues critical for packing interactions, etc. may all be fixed in a conformation or as a single rotamer, or "floated".

Similarly, residues which may be chosen as variable residues may be those that confer undesirable biological attributes, such as susceptibility to proteolytic degradation, dimerization or aggregation sites, glycosylation sites which may lead to immune responses, unwanted binding activity, unwanted allostery, undesirable enzyme activity but with a preservation of binding, etc.

In a preferred embodiment, each variable position is classified as either a core, surface or boundary residue position, although in some cases, as explained below, the variable position may be set to glycine to minimize backbone strain. In addition, as outlined herein, residues need not be classified, they can be chosen as variable and any set of amino acids may be used. Any combination of core, surface and boundary positions can be utilized: core, surface and boundary residues; core and surface residues; core and boundary residues, and surface and boundary residues, as well as core residues alone, surface residues alone, or boundary residues alone.

Classification of residue positions as core, surface or boundary may be done in several ways, as will be appreciated by those of skill in the art. In a preferred embodiment, the classification is done via a visual scan of the original protein backbone structure, including the side chains, and assigning a classification based on a subjective evaluation of one skilled in the art of protein modeling. Alternatively, a preferred embodiment utilizes an assessment of the orientation of the $C\alpha$–$C\beta$ vectors relative to a solvent accessible surface computed using only the template $C\alpha$ atoms, as outlined in U.S. Ser. Nos. 60/061,097, 60/043,464, 60/054,678, 09/127,926 and PCT US98/07254. Alternatively, a surface area calculation can be done.

Once each variable position is optionally classified as either core, surface or boundary, a set of amino acid side chains, and thus a set of rotamers, is assigned to each position. That is, the set of possible amino acid side chains that the program will allow to be considered at any particular position is chosen. Subsequently, once the possible amino acid side chains are chosen, the set of rotamers that will be evaluated at a particular position can be determined. Thus, a core residue will generally be selected from the group of hydrophobic residues consisting of alanine, valine, isoleucine, leucine, phenylalanine, tyrosine, tryptophan, and methionine (in some embodiments, when the $\alpha$ scaling factor of the van der Waals scoring function, described below, is low, methionine is removed from the set), and the rotamer set for each core position potentially includes rotamers for these eight amino acid side chains (all the rotamers if a backbone independent library is used, and subsets if a rotamer dependent backbone is used). Similarly, surface positions are generally selected from the group of hydrophilic residues consisting of alanine, serine, threonine, aspartic acid, asparagine, glutamine, glutamic acid, arginine, lysine and histidine. The rotamer set for each surface position thus includes rotamers for these ten residues. Finally, boundary positions are generally chosen from alanine, serine, threonine, aspartic acid, asparagine, glutamine, glutamic acid, arginine, lysine histidine, valine, isoleucine, leucine, phenylalanine, tyrosine, tryptophan, and methionine. The rotamer set for each boundary position thus potentially includes every rotamer for these seventeen residues (assuming cysteine, glycine and proline are not used, although they can be). Additionally, in some preferred embodiments, a set of 18 naturally occurring amino acids (all except cysteine and proline, which are known to be particularly disruptive) are used.

Thus, as will be appreciated by those in the art, there is a computational benefit to classifying the residue positions, as it decreases the number of calculations. It should also be noted that there may be situations where the sets of core, boundary and surface residues are altered from those described above; for example, under some circumstances, one or more amino acids is either added or subtracted from the set of allowed amino acids. For example, some proteins that dimerize or multimerize, or have ligand binding sites, may contain hydrophobic surface residues, etc. In addition, residues that do not allow helix "capping" or the favorable interaction with an -helix dipole may be subtracted from a set of allowed residues. This modification of amino acid groups is done on a residue by residue basis.

In a preferred embodiment, proline, cysteine and glycine are not included in the list of possible amino acid side chains, and thus the rotamers for these side chains are not used. However, in a preferred embodiment, when the variable residue position has a Φ angle (that is, the dihedral angle defined by 1) the carbonyl carbon of the preceding amino acid; 2) the nitrogen atom of the current residue; 3) the α-carbon of the current residue; and 4) the carbonyl carbon of the current residue) greater than 0°, the position is set to glycine to minimize backbone strain.

Once the group of potential rotamers is assigned for each variable residue position, processing proceeds as outlined in U.S. Ser. No. 09/127,926 and PCT US98/07254. This processing step entails analyzing interactions of the rotamers with each other and with the protein backbone to generate optimized protein sequences. Simplistically, the processing initially comprises the use of a number of scoring functions to calculate energies of interactions of the rotamers, either to the backbone itself or other rotamers. Preferred PDA scoring functions include, but are not limited to, a Van der Waals potential scoring function, a hydrogen bond potential scoring function, an atomic solvation scoring function, a secondary structure propensity scoring function and an electrostatic scoring function. As is further described below, at least one scoring function is used to score each position, although the scoring functions may differ depending on the position classification or other considerations, like favorable interaction with an α-helix dipole. As outlined below, the total energy which is used in the calculations is the sum of the energy of each scoring function used at a particular position, as is generally shown in Equation 1:

$$E_{total} = nE_{vdw} + nE_{as} + nE_{h\text{-}bonding} + nE_{ss} + nE_{elec}$$ Equation 1

In Equation 1, the total energy is the sum of the energy of the van der Waals potential ($E_{vdw}$), the energy of atomic solvation ($E_{as}$), the energy of hydrogen bonding ($E_{h\text{-}bonding}$), the energy of secondary structure ($E_{ss}$) and the energy of electrostatic interaction ($E_{elec}$). The term n is either 0 or 1, depending on whether the term is to be considered for the particular residue position.

As outlined in U.S. Ser. Nos. 60/061,097, 60/043,464, 60/054,678, 09/127,926 and PCT US98/07254, any combination of these scoring functions, either alone or in combination, may be used. Once the scoring functions to be used are identified for each variable position, the preferred first step in the computational analysis comprises the determination of the interaction of each possible rotamer with all or part of the remainder of the protein. That is, the energy of interaction, as measured by one or more of the scoring functions, of each possible rotamer at each variable residue position with either the backbone or other rotamers, is calculated. In a preferred embodiment, the interaction of each rotamer with the entire remainder of the protein, i.e. both the entire template and all other rotamers, is done. However, as outlined above, it is possible to only model a portion of a protein, for example a domain of a larger protein, and thus in some cases, not all of the protein need be considered. The term "portion", as used herein, with regard to a protein refers to a fragment of that protein. This fragment may range in size from 10 amino acid residues to the entire amino acid sequence minus one amino acid. Accordingly, the term "portion", as used herein, with regard to a nucleic refers to a fragment of that nucleic acid. This fragment may range in size from 10 nucleotides to the entire nucleic acid sequence minus one nucleotide.

In a preferred embodiment, the first step of the computational processing is done by calculating two sets of interactions for each rotamer at every position: the interaction of the rotamer side chain with the template or backbone (the "singles" energy), and the interaction of the rotamer side chain with all other possible rotamers at every other position (the "doubles" energy), whether that position is varied or floated. It should be understood that the backbone in this case includes both the atoms of the protein structure backbone, as well as the atoms of any fixed residues, wherein the fixed residues are defined as a particular conformation of an amino acid.

Thus, "singles" (rotamer/template) energies are calculated for the interaction of every possible rotamer at every variable residue position with the backbone, using some or all of the scoring functions. Thus, for the hydrogen bonding scoring function, every hydrogen bonding atom of the rotamer and every hydrogen bonding atom of the backbone is evaluated, and the $E_{HB}$ is calculated for each possible rotamer at every variable position. Similarly, for the van der Waals scoring function, every atom of the rotamer is compared to every atom of the template (generally excluding the backbone atoms of its own residue), and the $E_{vdW}$ is calculated for each possible rotamer at every variable residue position. In addition, generally no van der Waals energy is calculated if the atoms are connected by three bonds or less. For the atomic solvation scoring function, the surface of the rotamer is measured against the surface of the template, and the $E_{as}$ for each possible rotamer at every variable residue position is calculated. The secondary structure propensity scoring function is also considered as a singles energy, and thus the total singles energy may contain an $E_{ss}$ term. As will be appreciated by those in the art, many of these energy terms will be close to zero, depending on the physical distance between the rotamer and the template position; that is, the farther apart the two moieties, the lower the energy.

For the calculation of "doubles" energy (rotamer/rotamer), the interaction energy of each possible rotamer is compared with every possible rotamer at all other variable residue positions. Thus, "doubles" energies are calculated for the interaction of every possible rotamer at every variable residue position with every possible rotamer at every other variable residue position, using some or all of the scoring functions. Thus, for the hydrogen bonding scoring function, every hydrogen bonding atom of the first rotamer and every hydrogen bonding atom of every possible second rotamer is evaluated, and the $E_{HB}$ is calculated for each possible rotamer pair for any two variable positions. Similarly, for the van der Waals scoring function, every atom of the first rotamer is compared to every atom of every possible second rotamer, and the $E_{vdW}$ is calculated for each possible rotamer pair at every two variable residue positions. For the atomic solvation scoring function, the surface of the first rotamer is measured against the surface of every possible second rotamer, and the $E_{as}$ for each possible rotamer pair at every two variable residue positions is calculated. The secondary structure propensity scoring function need not be run as a "doubles" energy, as it is considered as a component of the "singles" energy. As will be appreciated by those in the art, many of these double energy terms will be close to zero, depending on the physical distance between the first rotamer and the second rotamer; that is, the farther apart the two moieties, the lower the energy.

In a preferred embodiment, a sequence prediction algorithm (SPA) is used to generate a variable protein sequence comprising a defined energy state for each amino acid position as is described in Raha, K., et al. (2000) Protein Sci., 9:1106–1119, U.S. Ser. No. 09/877,695, filed Jun. 8, 2001, entitled "Apparatus and Method for Designing Proteins and Protein Libraries"; both of which are expressly incorporated herein by reference.

In a preferred embodiment, force field calculations such as SCMF can be used generate a variable protein sequence comprising a defined energy state for each amino acid position. For SCMF, see Delarue et al., Pac. Symp. Biocomput. 109–21 (1997), Koehl et al., J. Mol. Biol. 239:249 (1994); Koehl et al., Nat. Struc. Biol. 2:163 (1995); Koehl et al., Curr. Opin. Struct. Biol. 6:222 (1996); Koehl et al., J. Mol. Bio. 293:1183 (1999); Koehl et al., J. Mol. Biol. 293:1161 (1999); Lee J. Mol. Biol. 236:918 (1994); and Vasquez Biopolymers 36:53–70 (1995); all of which are expressly incorporated by reference. Other force field calculations that can be used to optimize the conformation of a sequence within a computational method, or to generate de novo optimized sequences as outlined herein include, but are not limited to, OPLS_AA (Jorgensen, et al., J. Am. Chem. Soc. (1996), v 118, pp 11225_11236; Jorgensen, W. L.; BOSS, Version 4.1; Yale University: New Haven, Conn. (1999)); OPLS (Jorgensen, et al., J. Am. Chem. Soc. (1988), v 110, pp 1657ff; Jorgensen, et al., J Am. Chem. Soc. (1990), v 112, pp 4768ff); UNRES (United Residue Forcefield; Liwo, et al., Protein Science (1993), v 2, pp1697_1714; Liwo, et al., Protein Science (1993), v 2, pp1715_1731; Liwo, et al., J. Comp. Chem. (1997), v 18, pp849_873; Liwo, et al., J. Comp. Chem. (1997), v 18, pp874_884; Liwo, et al., J. Comp. Chem. (1998), v 19, pp259_276; Forcefield for Protein Structure Prediction (Liwo, et al., Proc. Natl. Acad. Sci. USA (1999), v 96, pp5482_5485); ECEPP/3 (Liwo et al., J Protein Chem 1994 May 13(4): 375_80); AMBER 1.1 force field (Weiner, et al., J. Am. Chem. Soc. v106, pp765_784); AMBER 3.0 force field (U. C. Singh et al., Proc. Natl. Acad. Sci. USA. 82:755_759); CHARMM and CHARMM22 (Brooks, et al., J. Comp. Chem. v4, pp 187_217); cvff3.0 (Dauber_Osguthorpe, et al., (1988) Proteins: Structure, Function and Genetics, v4, pp31_47); cff91 (Maple, et al., J. Comp. Ch em. v15, 162_182); also, the DISCOVER (cvff and cff91) and AMBER forcefields are used in the INSIGHT molecular modeling package (Biosym/MSI, San Diego Calif.) and HARMM is used in the QUANTA molecular modeling package (Biosym/MSI, San Diego Calif.), all of which are expressly incorporated by reference. In fact, as is outlined below, these force field methods may be used to generate the secondary library directly; that is, no primary library is generated; rather, these methods can be used to generate a probability table from which the secondary library is directly generated, for example by using these force fields during an SCMF calculation.

Once the singles and doubles energies are calculated and stored, the next step of the computational processing may occur. As outlined in U.S. Ser. No. 09/127,926 and PCT US98/07254, preferred embodiments utilize a Dead End Elimination (DEE) step, and preferably a Monte Carlo step. PDA™, viewed broadly, has three components that may be varied to alter the output (e.g. the primary library): the scoring functions used in the process; the filtering technique, and the sampling technique.

In a preferred embodiment, the scoring functions may be altered. In a preferred embodiment, the scoring functions outlined above may be biased or weighted in a variety of ways. For example, a bias towards or away from a reference sequence or family of sequences can be done; for example, a bias towards wild-type or homolog residues may be used. Similarly, the entire protein or a fragment of it may be biased; for example, the active site may be biased towards wild-type residues, or domain residues towards a particular desired physical property can be done. Furthermore, a bias towards or against increased energy can be generated. Additional scoring function biases include, but are not limited to applying electrostatic potential gradients or hydrophobicity gradients, adding a substrate or binding partner to the calculation, or biasing towards a desired charge or hydrophobicity.

In addition, in an alternative embodiment, there are a variety of additional scoring functions that may be used. Additional scoring functions include, but are not limited to torsional potentials, or residue pair potentials, or residue entropy potentials. Such additional scoring functions can be used alone, or as functions for processing the library after it is scored initially. For example, a variety of functions derived from data on binding of peptides to MHC (Major Histocompatibility Complex) can be used to rescore a library in order to eliminate proteins containing sequences which can potentially bind to MHC, i.e. potentially immunogenic sequences.

In a preferred embodiment, a variety of filtering techniques can be done, including, but not limited to, DEE and its related counterparts. Additional filtering techniques include, but are not limited to branch-and-bound techniques for finding optimal sequences (Gordon and Majo, Structure Fold. Des. 7:1089–98, 1999), and exhaustive enumeration of sequences. It should be noted however, that some techniques may also be done without any filtering techniques; for example, sampling techniques can be used to find good sequences, in the absence of filtering.

As will be appreciated by those in the art, once an optimized sequence or set of sequences is generated, a variety of sequence space sampling methods can be done, either in addition to the preferred Monte Carlo methods, or instead of a Monte Carlo search. That is, once a sequence or set of sequences is generated, preferred methods utilize sampling techniques to allow the generation of additional, related sequences for testing.

These sampling methods can include the use of amino acid substitutions, insertions or deletions, or recombinations of one or more sequences. As outlined herein, a preferred embodiment utilizes a Monte Carlo search, which is a series of biased, systematic, or random jumps. However, there are other sampling techniques that can be used, including Boltzman sampling, genetic algorithm techniques and simulated annealing. In addition, for all the sampling techniques, the kinds of jumps allowed can be altered (e.g. random jumps to random residues, biased jumps (to or away from wild-type, for example), jumps to biased residues (to or away from similar residues, for example, etc.). Jumps where multiple residue positions are coupled (two residues always change together, or never change together), jumps where whole sets of residues change to other sequences (e.g., recombination). Similarly, for all the sampling techniques, the acceptance criteria of whether a sampling jump is accepted can be altered, to allow broad searches at high temperature and narrow searches close to local optima at low temperatures. See Metropolis et al., J. Chem Phys v21, pp 1087, 1953, hereby expressly incorporated by reference.

In addition, it should be noted that the preferred methods of the invention result in a rank ordered list of sequences; that is, the sequences are ranked on the basis of some objective criteria. However, as outlined herein, it is possible to create a set of non-ordered sequences, for example by generating a probability table directly (for example using SCMF analysis or sequence alignment techniques) that lists sequences without ranking them. The sampling techniques outlined herein can be used in either situation.

In a preferred embodiment, Boltzman sampling is done. As will be appreciated by those in the art, the temperature criteria for Boltzman sampling can be altered to allow broad searches at high temperature and narrow searches close to local optima at low temperatures (see e.g., Metropolis et al., J. Chem. Phys. 21:1087, 1953).

In a preferred embodiment, the sampling technique utilizes genetic algorithms, e.g., such as those described by Holland (Adaptation in Natural and Artificial Systems, 1975, Ann Arbor, U. Michigan Press). Genetic algorithm analysis generally takes generated sequences and recombines them computationally, similar to a nucleic acid recombination event, in a manner similar to "gene shuffling". Thus the "jumps" of genetic algorithm analysis generally are multiple position jumps. In addition, as outlined below, correlated multiple jumps may also be done. Such jumps can occur with different crossover positions and more than one recombination at a time, and can involve recombination of two or more sequences. Furthermore, deletions or insertions (random or biased) can be done. In addition, as outlined below, genetic algorithm analysis may also be used after the secondary library has been generated.

In a preferred embodiment, the sampling technique utilizes simulated annealing, e.g., such as described by Kirkpatrick et al. [Science, 220:671–680 (1983)]. Simulated annealing alters the cutoff for accepting good or bad jumps by altering the temperature. That is, the stringency of the cutoff is altered by altering the temperature. This allows broad searches at high temperature to new areas of sequence space, altering with narrow searches at low temperature to explore regions in detail.

In addition, there are computational methods that may be used as described in U.S. Ser. Nos. 09/927,790, 60/352,103, and 60/351,937, all of which are expressly incorporated herein by reference.

Any protein design cycle can be used individually, in combination with other methods, or in reiterations that combine methods.

In a preferred embodiment, the methods of the invention involve starting with a target protein and use experimental methods to generate a variant protein. That is, nucleic acid recombination techniques as are known to one of skill in the art are used to experimentally generate the variant proteins of the present invention.

Thus, use of a nucleic acid recombination method or implementation of a protein design cycle, or a combination of nucleic acid recombination methods and computational processing results in the generation of a variant protein exhibiting altered cofactor specificity. By "variant protein" or "variable protein sequence" herein is meant a protein that differs from the scaffold protein or target protein in at least one amino acid residue.

In a preferred embodiment, the cofactor specificity of the variant protein is altered compare to the target protein. Target proteins include but are not limited to thioredoxin reductase, glutathione reductase, and 2,5-diketo-D-gluconic acid reductase. Two specific amino acid regions have previously been reported for cofactor specificity (Carugo and Argos, Proteins (1997) 28, 10–28). The first region immediately follows the Gly-rich loop with the motif G-x-G-x-$X_1$-$X_2$, and is involved in pyridine nucleotide binding. Originally, it was believed that in proteins specific for NADPH, $X_1$ and $X_2$ are polar residues (Ser/Thr) and Ala, respectively, whereas for proteins specific for NADH, $X_1$ and $X_2$ are hydrophobic residues (Val/Ile) and Gly, respectively. The determination of additional sequences, however, demonstrated significant sequence variability for $X_1$ and $X_2$, breaking this original rule for cofactor specificity.

The second region is reported as generally corresponding to the region from about amino acid 175 to amino acid 181 in *E. coli* thioredoxin reductase. In the NADH-dependent bacterial flavoprotein reductases Cp34 and AhpF (Reynolds et al., Biochemistry (2002) 41, 1990–2001), the second motif is reported as H-Q-F-x-x-x-Q and E-F-A-x-x-x-K (SEQ ID NOS:76–77), respectively. In a mutation study (Scrutton et al., Nature (1990) 343, 38–43; Mittl et al., Protein Sci. (1994) 3, 1504–1514), the NADPH specificity of *E. coli* GR was switched to NADHI by mutation of the second motif to E-M-F-x-x-x-x-P (SEQ ID NO:78).

In a preferred embodiment, a variant thioredoxin reductase is made in which the cofactor specificity is altered. Thioredoxin (TR) is a potent protein disulfide reductase found in most organisms that participates in many thiol-dependent cellular reductive processes. In addition to its ability to effect the reduction of cellular proteins, it is recognized that thioredoxin reductase can act directly as an antioxidant (e.g., by preventing oxidation of an oxidizable substrate by scavenging reactive oxygen species) or can increase the oxidative stress in a cell by autooxidizing (e.g., generating superoxide radicals through autooxidation).

Thioredoxins are low molecular weight dithiol proteins that have the ability to reduce disulfides in typical organic compounds such as Ellman's reagent or disulfides as they exist naturally in a variety of proteins (Holmgren, A. (1981) *Trends in Biochemical Science*, 6, 26–39). Under normal physiological conditions, following the reduction of a disulfide bond, the oxidized thioredoxin is reduced by thioredoxin reductase, with the aid of NADPH as a cofactor. Thioredoxin of a species is typically reduced only by thioredoxin reductase of the same species.

The active site pocket of the thioredoxin reductases exhibits a highly conserved region across species, as shown in the amino acid alignment of FIG. 1A. This region corresponds to the amino acid region between residues 156 and 181 of the *E. coli* thioredoxin reductase, or residues 220 and 245 of the *Arabidopsis* thioredoxin reductase. This highly conserved pocket is mostly responsible for the binding of the co-factor, NADPH. The trans-species variations in the amino acid sequence of thioredoxin reductase appear in the C- and N-termini regions, i.e., the region between residues 1–155 and 182-C-terminus of the *E. coli* thioredoxin reductase, or residues 1–219 and 246-C-terminus of the *Arabidopsis* thioredoxin reductase.

The target proteins used to generate the variant thioredoxin reductases of the present invention may be obtained from any organism including, but not limited to, *E. coli, Bacillus subtillis, Mycobacterium leprae, Sarccharomyces, Neurospora crassa, Arabidopsis, Homo sapiens, Methanosarcina acetivorans* str. C2A, *Ureaplasma parvum, Mycoplasma pulmonis, Rickettsia conorii, Spironucleus barkhanus, Listeria innocua, Fusobacterium nucleatum, Methanococcus jannaschii, Mycoplasma genitalium, Haemophilus influenzae, Vibrio cholera, Listeria monocytogenes, Helicobacter pylori, Methanopyrus kandleri* AV19, *Schizosaccharomyces pombe, Chlamydophila pneumoniae, Streptococcus pyogenes, Plasmodium falciparum, Mycobacterium tuberculosis, Mycoplasma genitalium, Borrelia burgdorferi, Ralstonia solanacearum, Sinorhizobium meliloti,*

*Caulobacter crescentus* CB15], *Encephalitozoon cuniculi, Staphylococcus aureus, Clostridium perfringens, Halobacterium* sp. NRC-1, *Sulfolobus solfataricus, Rickettsia prowazekii, Mesorhizobium loti, Mus musculus, Thermoplasma acidophilum, Sulfolobus tokodaii, Chlamydophila pneumoniae, Mycoplasma pulmonis, Campylobacter jejuni, Chlamydia trachomatis, Aeropyrum pemix, Neisseria meningitides, Pyrococcus horikoshii, Pyrococcus abyssi, Thermoplasma volcanium, Pyrococcus furiosus, Archaeoglobus fulgidus, Yersinia pestis, Bacillus halodurans, Ureaplasma urealyticum, Methanothermobacter thermautotrophicus, Pyrobaculum aerophilum, Chlamydia muridarum, Treponema pallidum, Streptomyces coelicolor, Brucella melitensis, Agrobacterium tumefaciens, Drosophila melanogaster, Streptococcus pneumoniae, Clostridium acetobutylicum, Xylella fastidiosa, Lactococcus lactis, Thermotoga maritime, Pseudomonas aeruginosa, Salmonella enterica, Nostoc* sp, *Deinococcus radiodurans, Penicillium chrysogenum, Salmonella typhimurium, Lactobacillus elbrueckii, Clostridium sticklandii, Clostridium litorale, Clostridium acetobutylicum, Thermoplasma volcanium, Rattus norvegicus, Coccidioides immitis, Bos Taurus, Mycobacterium smegmatis, Synechocystis* sp, *Plasmodium falciparum, Carboxydothermus hydrogenoformans, Sus scrofa Triticum aestivum.*

In a preferred embodiment, the target proteins used to generate the variant thioredoxin reductases are selected from *E. coli, Bacillus subtillis, Mycobacterium leprae, Saccharomyces, Neurospora crassa, Arabidopsis, Homo sapiens*, barley TR found in U.S. Pat. No. 6,380,372, entitled *Barley* gene for Thioredoxin and NADP-thioredoxin reductase, issued 20020430; rice TR found in WO0198509 as amino acid sequence of SEQ ID NO:27 therein and its nucleotide sequence as sequence of SEQ ID NO:25 therein, the heat stable TRs from *Archaeoglobusfulgidus* (gil2649006) (trxB) which is the protein sequence SEQ ID NO:7 in WO0198509, and the protein sequence of TR from *Methanococcus jannaschii* (gil 1592167) (trxB), which is SEQ ID NO:6 in WO0198509.

In a preferred embodiment, the catalytic efficiency of the variant TR proteins is improved for the cofactor NADPH. Preferably, the catalytic efficiency of variant TRs is improved by at least about 5% as compared to wild-type for NADPH. More preferably, the catalytic efficiency of variant TRs is improved by at least about 15% as compared to wild-type for NADPH. More preferably the catalytic efficiency of variant TRs is improved by at least about 25% as compared to wild-type for NADPH. More preferably, the catalytic efficiency of variant TRs is improved by at least about 50% as compared to wild-type for NADPH. More preferably, the catalytic efficiency of variant TRs is improved by at least about 100% as compared to wild-type for NADPH. More preferably, the catalytic efficiency of variant TRs is improved by at least about 300% as compared to wild-type for NADPH. More preferably, the catalytic efficiency of variant TRs is improved by at least 500% as compared to wild-type for NADPH.

In a preferred embodiment, the catalytic efficiency of the variant TR proteins is improved for the cofactor NADH. Preferably, the catalytic efficiency of variant TRs is improved by at least about 5% as cp,[ared to wild-type for NADH. More preferably the catalytic efficiency of variant Trs is improved by at least about 15% as compared to wild-type for NADH. More preferably, the catalytic efficiency of varoamt TRs is improved by at least about 25% as compared to wild-type for NADH. More preferably, the catalytic efficiency of variant TRs is improved by at least about 50% as compared to wild-type for NADH. More preferably, the catalytic efficiency of variant TRs is improved by at least about 100% as compared to wild-type for NADH. More preferably, the catalytic efficiency of variant TRs is improvedby at least about 300% as compared to wild-type for NADH. More preferably, the catalytic efficiency of variant TRs is improvedby at least about 500% as compared to wild-type for NADH. More preferably, the catalytic efficiency of variant TRs is improvedby at least about 1000% as compared to wild-type for NADH. More preferably, the catalytic efficiency of variant TRs is improvedby at least about 1300% as compared to wild-type for NADH. More preferably, the catalytic efficiency of variant TRs is improvedby at least about 3000% as compared to wild-type for NADH.

In a preferred embodiment, the cofactor specificity of the variant thioredoxin reductase is altered such that there is an increased activity using NADH. Preferably, variant thioredoxin reductases (TR) will have at least 50% of native NADPH dependent activity using NADH. More preferably, variant thioredoxin reductases (TR) will have at least 75% of native NADPH dependent activity using NADH. More preferably, variant thioredoxin reductases (TR) will have at least 85% of native NADPH dependent activity using NADH. More preferably, variant thioredoxin reductases (TR) will have at least 95% of native NADPH dependent activity using NADH. More preferably, variant thioredoxin reductases (TR) will have at least 100% of native NADPH dependent activity using NADH.

In a preferred embodiment, the cofactor specificity of the variant thioredoxin reductase is altered such that there is a cofactor switch from NADPH to NADH. In other words, these variants will have an increase in NADH-dependent activity and a substantially simultaneous decrease in NADPH dependent activity. Preferably, variant thioredoxin reductase (TRs) will have at least 50% of native NADPH dependent activity using NADH. More preferably, variant thioredoxin reductase will have at least 75% of native NADPH dependent activity using NADH. More preferably, variant thioredoxin reductase will have at least 85% of native NADPH dependent activity using NADH. More preferably, variant thioredoxin reductase will have at least 95% of native NADPH dependent activity using NADH. More preferably, variant thioredoxin reductase will have at least 100% of native NADPH dependent activity using NADH.

Preferably, variant thioredoxin reductases (TRs) will have less than about 0.5% of native NADPH dependent activity. More preferably, TRs will have less than about 5% of native NADPH dependent activity. More preferably, TRs will have less than about 20% of native NADPH dependent activity. More preferably, TRs will have less than about 25% of native NADPH dependent activity. More preferably, TRs will have less than about 30% of native NADPH dependent activity. More preferably, TRs will have less than about 50% of native NADPH dependent activity. More preferably, TRs will have less than about 75% of native NADPH dependent activity. More preferably, TRs will have less than about 95% of native NADPH dependent activity.

In another embodiment, the catalytic efficiency of the variant TR proteins is improved for both co-factors, NADH and NADPH, together. Preferably, the catalytic efficiency of the TR variants is improved by at least about 5% as compared to wild-type for either of the two co-factors. More preferably, the catalytic efficiency of the TR variants is improved by at least about 50% as compared to wild-type for either of the two co-factors. More preferably, the catalytic efficiency of the TR variants is improved by at least about 100% as compared to wild-type for either of the two co-factors. More preferably, the catalytic efficiency of the TR variants is improved by at least about 300% as compared to wild-type for either of the two co-factors. More preferably, the catalytic efficiency of the TR variants is improved by at least about 1000% as compared to wild-type for either of the two co-factors. More preferably, the catalytic efficiency of the TR variants is improved by at least about 2000% as compared to wild-type for either of the two co-factors.

In a preferred embodiment, the NADPH binding affinity of the variant thioredoxin reductases (TRs) may be unaffected, reduced, or enhanced. For example, in some embodiments, variant TRs show greater than 100 times more affinity for NADPH than for NADH, while in other embodiments, variant TRs show greater than 50 times more affinity for NADPH than for NADH, or variant TRs may show greater than 25 times more affinity for NADPH than for NADH.

In a preferred embodiment, the ability of the variant TR protein to reduce its cognate thioredoxin is not substantially affected.

In a preferred embodiment, the substrate specificity of the variant TR protein is altered such that the TR protein may act on a thioredoxin protein from another species In some embodiments, potential glycoslylation sites added by protein design cycle may be removed without affecting activity by using a second protein design cycle.

In a preferred embodiment, the variant TR proteins have from 1 to 3 amino acid substitutions in amino acid regions involved in cofactor specificity as compared to the wild-type TR proteins. In other embodiments, the variant TR proteins have additional amino acid substitutions at other positions. Thus, variant TR proteins may have at least about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 different residues in other positions. As will be appreciated by those of skill in the art, the number of additional positions that may have amino acid substitutions will depend on the wild-type TR protein used to generate the variants. Thus, in some instances, up to 50 different positions may have amino acid substitutions.

In a preferred embodiment, the variant TR protein comprise amino acid substitutions are selected from positions A4, A5 and A6, corresponding to positions 240, 241, and 245 in the *Arabidopsis* NTR protein (Genbank accession no. Q39242), positions 156, 157, and 175 in the *E. coli* TR protein (Genbank accession no P09625), positions 155, 156, and 174 in the *Bacillus subtillis* TR protein (Genbank accession no P80880), positions 163, 164, and 182 in the *Mycobacterium leprae* TR protein (Genbank accession no P46843), residue 164, 165, and 183 in the *Sacchromyces* TR protein (Genbank accession no P29509 and P38816), positions 163, 164, and 182 in the *Neurospora crassa* TR protein (Genbank accession no P51978), residue 190, 191, and 195 in the *Arabidopsis* TR protein (Genbank accession no Q39243) and residue 217, 218 and 249 in the Human TR protein (Genbank accession no Q16881).

In a preferred embodiment, the variant TR proteins comprise amino acid substitutions selected from the group of substitutions consisting of RA4W, RA5L, R A5M, R A5I, R A5F, R A5V, R A5Y, RA5A, RA5S, RA5C, RA5T, RA6T, R A6S, R A6Q, R A6G, and R A6N, RA6D, RA6M, and RA6E In a preferred embodiment, the variant TR protein comprises the amino acid substitutions RA4W and RA6T (SEQ ID NOS:79–87).

In a preferred embodiment, the variant TR protein comprises the amino acid substitutions RA4W, RA5L, and RA6S (SEQ ID NOS:88–96).

In a preferred embodiment, the variant TR protein comprises the amino acid substitutions RA5Y and RA6N (SEQ ID NOS:97–105).

In a preferred embodiment, the variant TR protein comprises the amino acid substitutions RA4W, RA5F, and RA6Q (SEQ ID NOS:106–114).

In a preferred embodiment, the variant TR protein comprises the amino acid substitutions RA4W, RA5L, and RA6T (SEQ ID NOS:115–123).

In a preferred embodiment, the variant TR protein comprises the amino acid substitutions RA4W and RA6S (SEQ ID NOS:124–132).

In a preferred embodiment, the variant TR protein comprises the amino acid substitutions RA5Y and RA6N (SEQ ID NOS:133–141).

In a preferred embodiment, the variant TR protein comprises the amino acid substitutions RA5F and RA6N (SEQ ID NOS:142–150).

In a preferred embodiment, the variant TR protein comprises the amino acid substitutions RA4W, RA5M, and RA6S (SEQ ID NOS:151–159).

In a preferred embodiment, the variant TR protein comprises the amino acid substitutions RA4W, RA5I, and RA6S (SEQ ID NOS:160–168).

In a preferred embodiment, the variant TR protein comprises the amino acid substitutions RA4W, RA5F, and RA6Q (SEQ ID NOS:169–177).

In a preferred embodiment, the variant TR protein comprises the amino acid substitutions RA4W, and RA5V (SEQ ID NOS:178–186).

In a preferred embodiment, the variant TR protein comprises the amino acid substitutions RA4W, RA5M, and RA6G (SEQ ID NOS:187–195).

In a preferred embodiment, the variant TR protein comprises the amino acid substitutions RA4W, RA5V, and RA6G (SEQ ID NOS:196–104).

In a preferred embodiment, variant protein is a polypeptide molecule of Formula I.

$$S_1\text{-}A_1\text{-}A_2\text{-}S_2\text{-}A_3\text{-}A_4\text{-}A_5\text{-}S_3\text{-}A_6\text{-}S_4 \qquad (I)$$

where
  a) $S_1$ comprises a polypeptide sequence selected from the group consisting of SEQ ID NO:1, SEQ ID NO:2, SEQ ID NO:3, SEQ ID NO:4, SEQ ID NO:5, SEQ ID NO:6, and SEQ ID NO:7, or a sequence having substantial similarity thereto;
  b) $S_2$ comprises a polypeptide sequence selected from the group consisting of SEQ ID NO:8, SEQ ID NO:9, SEQ ID NO:10, SEQ ID NO:11, SEQ ID NO:12, SEQ ID NO:13, and SEQ ID NO:14, or a sequence having substantial similarity thereto;
  c) $S_3$ comprises a polypeptide sequence selected from the group consisting of SEQ ID NO:15, SEQ ID NO:16, SEQ ID NO:17, SEQ ID NO:18, SEQ ID NO:19, SEQ ID NO:20, and SEQ ID NO:21, or a sequence having substantial similarity thereto;
  d) $S_4$ comprises a polypeptide sequence selected from the group consisting of SEQ ID NO:22, SEQ ID NO:23, SEQ ID NO:24, SEQ ID NO:25, SEQ ID NO:26, SEQ ID NO:27, and SEQ ID NO:28, or a sequence having substantial similarity thereto;

e) $A_1$ is an amino acid moiety selected from the group consisting of serine, valine, glycine, alanine, leucine, isoleucine, methionine, phenylalanine, and tryptophan;

f) $A_2$ is an amino acid moiety selected from the group consisting of alanine, glycine, valine, leucine, isoleucine, methionine, phenylalanine, and tryptophan;

g) $A_3$ is an amino acid moiety selected from the group consisting of histidine, aspartic acid, glutamic acid, arginine, leucine, serine, threonine, cysteine, asparagine, glutamine, and tyrosine;

h) $A_4$ is an amino acid moiety selected from the group consisting of arginine, alanine, glycine, valine, leucine, isoleucine, methionine, phenylalanine, and tryptophan;

i) $A_5$ is an amino acid moiety selected from the group consisting of arginine, asparagine, glutamine, aspartic acid, glutamic acid, cysteine, serine, threonine, and lysine;

j) $A_6$ is an amino acid moiety selected from the group consisting of arginine, glutamic acid, asparagine, glutamine, aspartic acid, cysteine, serine, threonine, and lysine;

provided that at least
$A_1$ is not serine;
$A_2$ is not alanine;
$A_3$ is not histidine;
$A_4$ is not arginine;
$A_5$ is not arginine; or
$A_6$ is not arginine.

In Formula I, above, the sequence $A_1$-$A_2$-$S_2$-$A_3$-$A_4$-$A_5$-$S_3$-$A_6$ corresponds to a highly conserved pocket in the sequence of thioredoxin reductase proteins obtained from various species. $A_1$ corresponds to residue 156 in the *E. coli* thioredoxin reductase sequence, residue 155 in the *Bacillus subtillis* thioredoxin reductase sequence, residue 163 in the *Mycobacterium leprae* thioredoxin reductase sequence, residue 164 in the *Sarccharomyces* thioredoxin reductase sequence, residue 163 in the *Neurospora crassa* thioredoxin reductase sequence, residue 170 in the *Arabidopsis* thioredoxin reductase sequence, and residue 217 in the Human thioredoxin reductase sequence. In the wild-type protein, this residue is threonine for *E. coli* and human, and serine for the other listed species.

$A_2$ corresponds to residue 157 in the *E. coli* thioredoxin reductase sequence, residue 156 in the *Bacillus subtillis* thioredoxin reductase sequence, residue 164 in the *Mycobacterium leprae* thioredoxin reductase sequence, residue 165 in the *Sarccharomyces* thioredoxin reductase sequence, residue 164 in the *Neurospora crassa* thioredoxin reductase sequence, residue 171 in the *Arabidopsis* thioredoxin reductase sequence, residue 218 in the Human thioredoxin reductase sequence. In the wild-type protein, this residue is valine for human and alanine for all the other listed species.

$A_3$ corresponds to residue 175 in the *E. coli* thioredoxin reductase sequence, residue 174 in the *Bacillus subtillis* thioredoxin reductase sequence, residue 182 in the *Mycobacterium leprae* thioredoxin reductase sequence, residue 183 in the *Sarccharomyces* thioredoxin reductase sequence, residue 182 in the *Neurospora crassa* thioredoxin reductase sequence, residue 189 in the *Arabidopsis* thioredoxin reductase sequence, residue 249 in the Human thioredoxin reductase sequence. In the wild-type protein, this residue is arginine for human, valine for *Sarccharomyces* and *Neurospora crassa*, and histidine for all the other listed species.

$A_4$ corresponds to residue residue 176 in the *E. coli* thioredoxin reductase sequence, residue 175 in the *Bacillus subtillis* thioredoxin reductase sequence, residue 183 in the *Mycobacterium leprae* thioredoxin reductase sequence, residue 184 in the *Sarccharomyces* thioredoxin reductase sequence, residue 183 in the *Neurospora crassa* thioredoxin reductase sequence, residue 190 in the *Arabidopsis* thioredoxin reductase sequence, residue 250 in the Human thioredoxin reductase sequence. In the wild-type protein, this residue is glutamine for human and arginine for all the other listed species.

$A_5$ corresponds to residue 177 in the *E. coli* thioredoxin reductase sequence, residue 176 in the *Bacillus subtillis* thioredoxin reductase sequence, residue 184 in the *Mycobacterium leprae* thioredoxin reductase sequence, residue 185 in the *Sarccharomyces* thioredoxin reductase sequence, residue 184 in the *Neurospora crassa* thioredoxin reductase sequence, residue 191 in the *Arabidopsis* thioredoxin reductase sequence, residue 251 in the Human thioredoxin reductase sequence. In the wild-type protein, this residue is lysine for *Sarccharomyces* and *Neurospora crassa*, phenylalanine for human, and arginine for all the other listed species.

$A_6$ corresponds to residue 181 in the *E. coli* thioredoxin reductase sequence, residue 180 in the *Bacillus subtillis* thioredoxin reductase sequence, residue 188 in the *Mycobacterium leprae* thioredoxin reductase sequence, residue 189 in the *Sarccharomyces* thioredoxin reductase sequence, residue 188 in the *Neurospora crassa* thioredoxin reductase sequence, residue 195 in the *Arabidopsis* thioredoxin reductase sequence, residue 255 in the Human thioredoxin reductase sequence. In the wild-type protein, this residue is lysine for human and arginine for all the other listed species.

It has been observed that among the species mentioned above, the portion of the amino acid sequence corresponding to $S_2$ and $S_3$ are also highly conserved. $S_2$ comprises a polypeptide sequence selected from the group consisting of SEQ ID NO:8, SEQ ID NO:9, SEQ ID NO:10, SEQ ID NO:11, SEQ ID NO:12, SEQ ID NO:13, and SEQ ID NO:14. $S_3$ comprises a polypeptide sequence selected from the group consisting of SEQ ID NO:15, SEQ ID NO:16, SEQ ID NO:17, SEQ ID NO:18, SEQ ID NO:19, SEQ ID NO:20, and SEQ ID NO:21 (FIG. 2).

Therefore, embodiments of the invention relate to a polypeptide of Formula I, where $S_1$ consists of a polypeptide sequence having the sequence selected from the group consisting of SEQ ID NO:1, SEQ ID NO:2, SEQ ID NO:3, SEQ ID NO:4, SEQ ID NO:5, SEQ ID NO:6, and SEQ ID NO:7.

In certain embodiments, $S_2$ consists of a polypeptide sequence selected from the group consisting of SEQ ID NO:8, SEQ ID NO:9, SEQ ID NO:10, SEQ ID NO:11, SEQ ID NO:12, SEQ ID NO:13, and SEQ ID NO:14, whereas $S_3$ consists of a polypeptide sequence selected from the group consisting of SEQ ID NO:15, SEQ ID NO:16, SEQ ID NO:17, SEQ ID NO:18, SEQ ID NO:19, SEQ ID NO:20, and SEQ ID NO:21. Other embodiments of the invention relate to $S_4$ consisting of a polypeptide sequence having the sequence selected from the group consisting of SEQ ID NO:22, SEQ ID NO:23, SEQ ID NO:24, SEQ ID NO:25, SEQ ID NO:26, SEQ ID NO:27, and SEQ ID NO:28.

In one embodiment, in the polypeptide of Formula I, $S_1$ is the polypeptide sequence set forth in SEQ ID NO:1, $S_2$ is the polypeptide sequence set forth in SEQ ID NO:8, $S_3$ is the polypeptide sequence set forth in SEQ ID NO:15, and $S_4$ is the polypeptide sequence set forth in SEQ ID NO:22. This corresponds to a thioredoxin reductase protein, or a mutant thereof, obtained from *E. coli*.

In another embodiment, in the polypeptide of Formula I, $S_1$ is the polypeptide sequence set forth in SEQ ID NO:2, $S_2$ is the polypeptide sequence set forth in SEQ ID NO:9, $S_3$ is the polypeptide sequence set forth in SEQ ID NO:16, and $S_4$ is the polypeptide sequence set forth in SEQ ID NO:23. This corresponds to a thioredoxin reductase protein, or a mutant thereof, obtained from Bacillus subtillis.

In yet another embodiment, in the polypeptide of Formula I, $S_1$ is the polypeptide sequence set forth in SEQ ID NO:3, $S_2$ is the polypeptide sequence set forth in SEQ ID NO:10, $S_3$ is the polypeptide sequence set forth in SEQ ID NO:17, and $S_4$ is the polypeptide sequence set forth in SEQ ID NO:24. This corresponds to a thioredoxin reductase protein, or a mutant thereof, obtained from Mycobacterium leprae.

Another embodiment of the invention relates to a polypeptide of Formula I, in which $S_1$ is the polypeptide sequence set forth in SEQ ID NO:4, $S_2$ is the polypeptide sequence set forth in SEQ ID NO:11, $S_3$ is the polypeptide sequence set forth in SEQ ID NO:18, and $S_4$ is the polypeptide sequence set forth in SEQ ID NO:25. This corresponds to a thioredoxin reductase protein, or a mutant thereof, obtained from Sarccharomyces.

In another embodiment, in the polypeptide of Formula I, $S_1$ is the polypeptide sequence set forth in SEQ ID NO:5, $S_2$ is the polypeptide sequence set forth in SEQ ID NO:12, $S_3$ is the polypeptide sequence set forth in SEQ ID NO:19, and $S_4$ is the polypeptide sequence set forth in SEQ ID NO:26. This corresponds to a thioredoxin reductase protein, or a mutant thereof, obtained from Neurospora crassa.

In one embodiment, in the polypeptide of Formula I, $S_1$ is the polypeptide sequence set forth in SEQ ID NO:6, $S_2$ is the polypeptide sequence set forth in SEQ ID NO:13, $S_3$ is the polypeptide sequence set forth in SEQ ID NO:20, and $S_4$ is the polypeptide sequence set forth in SEQ ID NO:27. This corresponds to a thioredoxin reductase protein, or a mutant thereof, obtained from Arabidopsis.

The invention also relates to another polypeptide of Formula I, in which $S_1$ is the polypeptide sequence set forth in SEQ ID NO:7, $S_2$ is the polypeptide sequence set forth in SEQ ID NO:14, $S_3$ is the polypeptide sequence set forth in SEQ ID NO:21, and $S_4$ is the polypeptide sequence set forth in SEQ ID NO:28. This corresponds to a thioredoxin reductase protein, or a mutant thereof, obtained from Human.

The invention encompasses certain mutants of the naturally occurring thioredoxin reductase proteins. These mutants include those in which $A_1$ is an amino acid moiety selected from the group consisting of valine, alanine, and leucine; $A_2$ is an amino acid moiety selected from the group consisting of glycine, valine, and leucine; $A_3$ is an amino acid moiety selected from the group consisting of aspartic acid, glutamic acid, asparagine, and glutamine; $A_4$ is an amino acid moiety selected from the group consisting of alanine, glycine, valine, leucine, isoleucine, and methionine; $A_5$ is an amino acid moiety selected from the group consisting of asparagine, glutamine, aspartic acid, and glutamic acid; $A_6$ is an amino acid moiety selected from the group consisting of glutamic acid, glutamine, aspartic acid, and asparagine.

It is understood that a polypeptide of the present invention may have one or more than one of the above mutations.

In certain embodiments $A_1$ is valine, while in others $A_2$ is glycine, and in others $A_3$ is aspartic acid; and in others $A_4$ is alanine, while in others $A_5$ is asparagine, and in others $A_6$ is glutamic acid. In some embodiments, two or more of these particular amino acid residues exist at the specified position.

In a preferred embodiment the variant proteins of the present invention may be fused to a second protein. For example, a fusion protein comprising the polypeptide of Formula I and a second polypeptide may be made. The second polypeptide may be a wild-type TR protein, wild-type thioredoxin, or a variant designed by a protein design cycle. Alternatively, a fusion protein comprising a variant protein generated by a protein design cycle and a second polypeptide may be fused. The second polypeptide may be a wild-type TR protein, wild-type thioredoxin or the polypeptide of Formula I. Such fusion may be through a linker.

By "linker", "linker sequence", "spacer", tethering sequence" or grammatical equivalents thereof, herein is meant a molecule or group of molecules (such as a monomer or polymer) that connects two molecules and often serves to place the two molecules in a preferred configuration. In one aspect of this embodiment, the linker is a peptide bond. Choosing a suitable linker for a specific case where two polypeptide chains are to be connected depends on various parameters, e.g., the nature of the two polypeptide chains (e.g., whether they naturally form a dimer or not), the distance between the N- and the C-termini to be connected if known from three-dimensional structure determination, and/or the stability of the linker towards proteolysis and oxidation. Furthermore, the linker may contain amino acid residues that provide flexibility. Thus, the linker peptide may predominantly include the following amino acid residues: Gly, Ser, Ala, or Thr.

The linker peptide should have a length that is adequate to link two monomers in such a way that they assume the correct conformation relative to one another so that they retain the desired activity as antagonists of a given receptor. Suitable lengths for this purpose includes at least one and not more than 30 amino acid residues. Preferably, the linker is from about 1 to 30 amino acids in length, with linkers of 1, 2, 3, 4, 5, 6, 7, 8, 9, 10, 11, 12, 13, 14, 15, 16, 17, 18 19 and 20 amino acids in length being preferred. See also WO 01/25277, incorporated herein by reference in its entirety.

In addition, the amino acid residues selected for inclusion in the linker peptide should exhibit properties that do not interfere significantly with the activity of the polypeptide. Thus, the linker peptide on the whole should not exhibit a charge that would be inconsistent with the activity of the polypeptide, or interfere with internal folding, or form bonds or other interactions with amino acid residues in one or more of the monomers that would seriously impede the binding of receptor monomer domains.

Useful linkers include glycine-serine polymers (including, for example, $(GS)_n$, $(GSGGS)_n$ (SEQ ID NO:205) $(GGGGS)_n$ (SEQ ID NO:206) and $(GGGS)_n$ (SEQ ID NO:207), where n is an integer of at least one), glycine-alanine polymers, alanine-serine polymers, and other flexible linkers such as the tether for the shaker potassium channel, and a large variety of other flexible linkers, as will be appreciated by those in the art. Glycine-serine polymers are preferred since both of these amino acids are relatively unstructured, and therefore may be able to serve as a neutral tether between components. Secondly, serine is hydrophilic and therefore able to solubilize what could be a globular glycine chain. Third, similar chains have been shown to be effective in joining subunits of recombinant proteins such as single chain antibodies.

Suitable linkers may also be identified by screening databases of known three-dimensional structures for naturally occurring motifs that can bridge the gap between two polypeptide chains. Another way of obtaining a suitable linker is by optimizing a simple linker, e.g., $(Gly4Ser)_n$ (SEQ ID NO:206), through random mutagenesis.

In a preferred embodiment, the linker may comprise a polypeptide sequence having between about 5 and about 50 amino acids, or between about 10 and about 40 amino acids, or between about 15 and about 25 amino acids. In a preferred embodiment, the linker is about 22 amino acids.

In a preferred embodiment, the variant proteins of the present invention may be fused to a third polypeptide, and again, such fusion may be through a linker. The linker between the fusion polypeptide, which includes the polypeptide of Formula I, and the third polypeptide may have a molecular weight between about 5 and about 100 kDa, or a molecular weight between about 20 and about 70 kDa, or even a molecular weight between about 25 and about 45 kDa. In a preferred embodiment, the linker has a molecular weight of between about 30 to about 40 kDa. In certain embodiments, this linker comprises amino acid residues that are negatively charged, such as glutamate and aspartate.

In certain embodiments, the third polypeptide is oleosin.

Thus, one embodiment of the present invention relates to a polypeptide of Formula I, which is fused to a second polypeptide at its C-terminus, perhaps through a linker, and is also fused to a third polypeptide at its N-terminus, again perhaps through another linker. Another embodiment of the invention relates to a series of fused polypeptides of Formula II $$\text{oleosin-linker 1-thioredoxin reductase-linker 2-thioredoxin} \quad (II)$$

where "linker 1" refers to the linker between the polypeptide of Formula I and the third polypeptide, set forth above, and "linker 2" refers to the linker between the polypeptide of Formula I and the second polypeptide, set forth above. Likewise, some embodiments of the invention can include any other fusion protein comprising the polypeptide of Formula I, whether it is fused to another protein at its N-terminus, its C-terminus, or both. Specifically, the invention contemplates modifications of Formula II or any other fusion of two polypeptides to the polypeptide of Formula I in which the components occur in any order.

In a preferred embodiment, the binding affinities of variant TR proteins for NADPH and NADH are determined. Suitable assays include, but are not limited to, e.g., quantitative comparisons comparing kinetic and equilibrium binding constants. The kinetic association rate ($K_{on}$) and dissociation rate ($K_{off}$), and the equilibrium binding constants ($K_d$) can be determined using surface plasmon resonance on a BIAcore instrument following the standard procedure in the literature [Pearce et al., Biochemistry 38:81–89 (1999)].

In a preferred embodiment, the antigenic profile in the host animal of the variant TR protein is similar, and preferably identical, to the antigenic profile of the host TR that is, the variant TR protein does not significantly stimulate the host organism (e.g. the patient) to an immune response; that is, any immune response is not clinically relevant and there is no allergic response or neutralization of the protein by an antibody. That is, in a preferred embodiment, the variant TR protein does not contain additional or different epitopes from the TR. By "epitope" or "determinant" herein is meant a portion of a protein which will generate and/or bind an antibody. Thus, in most instances, no significant amounts of antibodies are generated to a variant TR protein. In general, this is accomplished by not significantly altering surface residues, or by adding any amino acid residues on the surface which can become glycosylated, as novel glycosylation can result in an immune response.

The variant TR proteins and nucleic acids of the invention are distinguishable from naturally occurring wild-type TR.

By "naturally occurring" or "wild type" or grammatical equivalents, herein is meant an amino acid sequence or a nucleotide sequence that is found in nature and includes allelic variations; that is, an amino acid sequence or a nucleotide sequence that usually has not been intentionally modified. Accordingly, by "non-naturally occurring" or "synthetic" or "recombinant" or grammatical equivalents thereof, herein is meant an amino acid sequence or a nucleotide sequence that is not found in nature; that is, an amino acid sequence or a nucleotide sequence that usually has been intentionally modified. It is understood that once a recombinant nucleic acid is made and reintroduced into a host cell or organism, it will replicate non-recombinantly, i.e., using the in vivo cellular machinery of the host cell rather than in vitro manipulations, however, such nucleic acids, once produced recombinantly, although subsequently replicated non-recombinantly, are still considered recombinant for the purpose of the invention. Representative amino acid sequences of naturally occurring TR proteins are shown in FIG. 21. It should be noted that unless otherwise stated, all positional numbering of variant TR proteins and variant TR proteins is based on these sequences. That is, as will be appreciated by those in the art, an alignment of TR proteins and variant TR proteins can be done using standard programs, as is outlined below, with the identification of "equivalent" positions between the two proteins.

Thus, in a preferred embodiment, the variant TR protein has an amino acid sequence that differs from a wild-type TR sequence (FIG. 21) by at least 1–5% of the residues. That is, the variant TR proteins of the invention are less than about 97–99% identical to a wild-type TR amino acid sequence. Accordingly, a protein is a "variant TR protein" if the overall homology of the protein sequence to the amino acid sequence is preferably less than about 99%, more preferably less than about 98%, even more preferably less than about 97% and more preferably less than 95% of a wild-type TR protein. In some embodiments, the homology will be as low as about 75–80%. Stated differently, variant TR proteins have at least about 1 residue that differs from the wild-type TR sequence (i.e., FIG. 21), with at least about 2, 3, 4, 5, up to 50 different residues. Preferably variant TR proteins have 1 to 3 different residues. More preferably, variant TR proteins have 3 to 5 different residues. Preferably variant TR proteins have 5 to 10 different residues. Preferably variant TR proteins have 10 to 15 different residues. Preferably variant TR proteins have 15 to 25 different residues. Preferably variant TR proteins have 25 to 35 different residues.

Homology in this context means sequence similarity or identity, with identity being preferred. As is known in the art, a number of different programs can be used to identify whether a protein (or nucleic acid as discussed below) has sequence identity or similarity to a known sequence. Sequence identity and/or similarity is determined using standard techniques known in the art, including, but not limited to, the local sequence identity algorithm of Smith & Waterman, Adv. Appl. Math., 2:482 (1981), by the sequence identity alignment algorithm of Needleman & Wunsch, J. Mol. Biol., 48:443 (1970), by the search for similarity method of Pearson & Lipman, Proc. Natl. Acad. Sci. U.S.A., 85:2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., Nucl. Acid Res., 12:387–395 (1984), preferably using the default settings, or by inspection. Preferably, percent identity is calculated by FastDB based upon the following parameters:

mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127–149 (1988), Alan R. Liss, Inc.

An example of a useful algorithm is PILEUP. PILEUP creates a multiple sequence alignment from a group of related sequences using progressive, pair wise alignments. It can also plot a tree showing the clustering relationships used to create the alignment. PILEUP uses a simplification of the progressive alignment method of Feng & Doolittle, J. Mol. Evol. 35:351–360 (1987); the method is similar to that described by Higgins & Sharp CABIOS 5:151–153 (1989). Useful PILEUP parameters including a default gap weight of 3.00, a default gap length weight of 0.10, and weighted end gaps.

Another example of a useful algorithm is the BLAST algorithm, described in: Altschul et al., J. Mol. Biol. 215, 403–410, (1990); Altschul et al., Nucleic Acids Res. 25:3389–3402 (1997); and Karlin et al., Proc. Natl. Acad. Sci. U.S.A. 90:5873–5787 (1993). A particularly useful BLAST program is the WU-BLAST-2 program which was obtained from Altschul et al., Methods in Enzymology, 266:460–480 (1996); http://blast.wustl/edu/blast/README.html]. WU-BLAST-2 uses several search parameters, most of which are set to the default values. The adjustable parameters are set with the following values: overlap span=1, overlap fraction=0.125, word threshold (T)=11. The HSP S and HSP S2 parameters are dynamic values and are established by the program itself depending upon the composition of the particular sequence and composition of the particular database against which the sequence of interest is being searched; however, the values may be adjusted to increase sensitivity. An additional useful algorithm is gapped BLAST as reported by Altschul et al., Nucl. Acids Res., 25:3389–3402. Gapped BLAST uses BLOSUM-62 substitution scores; threshold T parameter set to 9; the two-hit method to trigger ungapped extensions; charges gap lengths of k a cost of 10+k; $X_u$ set to 16, and $X_g$ set to 40 for database search stage and to 67 for the output stage of the algorithms. Gapped alignments are triggered by a score corresponding to ~22 bits.

A % amino acid sequence identity value is determined by the number of matching identical residues divided by the total number of residues of the "longer" sequence in the aligned region. The "longer" sequence is the one having the most actual residues in the aligned region (gaps introduced by WU-Blast-2 to maximize the alignment score are ignored).

In a similar manner, "percent (%) nucleic acid sequence identity" with respect to the coding sequence of the polypeptides identified herein is defined as the percentage of nucleotide residues in a candidate sequence that are identical with the nucleotide residues in the coding sequence of the cell cycle protein. A preferred method utilizes the BLASTN module of WU-BLAST-2 set to the default parameters, with overlap span and overlap fraction set to 1 and 0.125, respectively.

The alignment may include the introduction of gaps in the sequences to be aligned. In addition, for sequences which contain either more or fewer amino acids than a wild-type TR sequence (i.e., see FIG. 2, FIG. 16N), it is understood that in one embodiment, the percentage of sequence identity will be determined based on the number of identical amino acids in relation to the total number of amino acids. Thus, for example, sequence identity of sequences shorter than a wild-type TR protein sequence (i.e., see FIG. 2, FIG. 16N), as discussed below, will be determined using the number of amino acids in the shorter sequence, in one embodiment. In percent identity calculations relative weight is not assigned to various manifestations of sequence variation, such as, insertions, deletions, substitutions, etc.

In one embodiment, only identities are scored positively (+1) and all forms of sequence variation including gaps are assigned a value of "0", which obviates the need for a weighted scale or parameters as described below for sequence similarity calculations. Percent sequence identity can be calculated, for example, by dividing the number of matching identical residues by the total number of residues of the "shorter" sequence in the aligned region and multiplying by 100. The "longer" sequence is the one having the most actual residues in the aligned region.

Thus, the variant TR proteins of the present invention may be shorter or longer than the amino acid sequence of wild-type TR proteins (i.e., FIG. 21. Thus, in a preferred embodiment, included within the definition of variant TR proteins are portions or fragments of the sequences depicted herein. Fragments of variant TR proteins are considered variant TR proteins if a) they share at least one antigenic epitope; b) have at least the indicated homology; c) and preferably have variant TR biological activity as defined herein.

In a preferred embodiment, as is more fully outlined below, the variant TR proteins include further amino acid variations, as compared to a wild type TR, than those outlined herein. In addition, as outlined herein, any of the variations depicted herein may be combined in any way to form additional novel variant TR proteins.

In addition, variant TR proteins can be made that are longer than those depicted in the figures, for example, by the addition of epitope or purification tags, as outlined herein, the addition of other fusion sequences, etc. For example, the variant TR proteins of the invention may be fused to other therapeutic proteins or to other proteins such as Fc or serum albumin for pharmacokinetic purposes. See for example U.S. Pat. Nos. 5,766,883 and 5,876,969, both of which are expressly incorporated by reference.

In a preferred embodiment, the variant TR proteins of the invention are human TR conformers. By "conformer" herein is meant a protein that has a protein backbone 3D structure that is virtually the same but has significant differences in the amino acid side chains. That is, the variant TR proteins of the invention define a conformer set, wherein all of the proteins of the set share a backbone structure and yet have sequences that differ by at least 1–3–5%. The three dimensional backbone structure of a variant TR protein thus substantially corresponds to the three dimensional backbone structure of human TR. "Backbone" in this context means the non-side chain atoms: the nitrogen, carbonyl carbon and oxygen, and the α-carbon, and the hydrogens attached to the nitrogen and α-carbon. To be considered a conformer, a protein must have backbone atoms that are no more than 2 angstroms from the human TR structure, with no more than 1.5 angstroms being preferred, and no more than 1 angstrom being particularly preferred. In general, these distances may be determined in two ways. In one embodiment, each potential conformer is crystallized and its three dimensional structure determined. Alternatively, as the former is quite tedious, the sequence of each potential conformer is run in the PDA program to determine whether it is a conformer.

In alternative embodiments, the variant TR proteins of the invention may be conformers of any of the TR proteins listed in FIG. 21.

Variant TR proteins may also be identified as being encoded by variant TR nucleic acids. In the case of the nucleic acid, the overall homology of the nucleic acid sequence is commensurate with amino acid homology but takes into account the degeneracy in the genetic code and codon bias of different organisms. Accordingly, the nucleic acid sequence homology may be either lower or higher than that of the protein sequence, with lower homology being preferred.

In a preferred embodiment, a variant TR nucleic acid encodes a variant TR protein. As will be appreciated by those in the art, due to the degeneracy of the genetic code, an extremely large number of nucleic acids may be made, all of which encode the variant TR proteins of the present invention. Thus, having identified a particular amino acid sequence, those skilled in the art could make any number of different nucleic acids, by simply modifying the sequence of one or more codons in a way which does not change the amino acid sequence of the variant TR.

In one embodiment, the nucleic acid homology is determined through hybridization studies. Thus, for example, nucleic acids which hybridize under high stringency to the nucleic acid sequence shown in FIG. 21 or its complement and encode a variant TR protein is considered a variant TR gene.

High stringency conditions are known in the art; see for example Maniatis et al., Molecular Cloning: A Laboratory Manual, 2d Edition, 1989, and Short Protocols in Molecular Biology, ed. Ausubel, et al., both of which are hereby incorporated by reference. Stringent conditions are sequence-dependent and will be different in different circumstances. Longer sequences hybridize specifically at higher temperatures. An extensive guide to the hybridization of nucleic acids is found in Tijssen, Techniques in Biochemistry and Molecular Biology—Hybridization with Nucleic Acid Probes, "Overview of principles of hybridization and the strategy of nucleic acid assays" (1993). Generally, stringent conditions are selected to be about 5–10° C. lower than the thermal melting point ($T_m$) for the specific sequence at a defined ionic strength and pH. The $T_m$ is the temperature (under defined ionic strength, pH and nucleic acid concentration) at which 50% of the probes complementary to the target hybridize to the target sequence at equilibrium (as the target sequences are present in excess, at $T_m$, 50% of the probes are occupied at equilibrium). Stringent conditions will be those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g. 10 to 50 nucleotides) and at least about 60° C. for long probes (e.g. greater than 50 nucleotides). Stringent conditions may also be achieved with the addition of destabilizing agents such as formamide.

In another embodiment, less stringent hybridization conditions are used; for example, moderate or low stringency conditions may be used, as are known in the art; see Maniatis and Ausubel, supra, and Tijssen, supra.

The variant TR proteins and nucleic acids of the present invention are recombinant. As used herein, "nucleic acid" may refer to either DNA or RNA, or molecules which contain both deoxy- and ribonucleotides. The nucleic acids include genomic DNA, cDNA and oligonucleotides including sense and anti-sense nucleic acids. Such nucleic acids may also contain modifications in the ribose-phosphate backbone to increase stability and half life of such molecules in physiological environments.

The nucleic acid may be double stranded, single stranded, or contain portions of both double stranded or single stranded sequence. As will be appreciated by those in the art, the depiction of a single strand ("Watson") also defines the sequence of the other strand ("Crick"); thus the sequence depicted in FIG. 6 also includes the complement of the sequence. By the term "recombinant nucleic acid" herein is meant nucleic acid, originally formed in vitro, in general, by the manipulation of nucleic acid by endonucleases, in a form not normally found in nature. Thus an isolated variant TR nucleic acid, in a linear form, or an expression vector formed in vitro by ligating DNA molecules that are not normally joined, are both considered recombinant for the purposes of this invention. It is understood that once a recombinant nucleic acid is made and reintroduced into a host cell or organism, it will replicate non-recombinantly, i.e. using the in vivo cellular machinery of the host cell rather than in vitro manipulations; however, such nucleic acids, once produced recombinantly, although subsequently replicated non-recombinantly, are still considered recombinant for the purposes of the invention.

Similarly, a "recombinant protein" is a protein made using recombinant techniques, i.e. through the expression of a recombinant nucleic acid as depicted above. A recombinant protein is distinguished from naturally occurring protein by at least one or more characteristics. For example, the protein may be isolated or purified away from some or all of the proteins and compounds with which it is normally associated in its wild type host, and thus may be substantially pure. For example, an isolated protein is unaccompanied by at least some of the material with which it is normally associated in its natural state, preferably constituting at least about 0.5%, more preferably at least about 5% by weight of the total protein in a given sample. A substantially pure protein comprises at least about 75% by weight of the total protein, with at least about 80% being preferred, and at least about 90% being particularly preferred. The definition includes the production of a variant TR protein from one organism in a different organism or host cell. Alternatively, the protein may be made at a significantly higher concentration than is normally seen, through the use of a inducible promoter or high expression promoter, such that the protein is made at increased concentration levels. Furthermore, all of the variant TR proteins outlined herein are in a form not normally found in nature, as they contain amino acid substitutions, insertions and deletions, with substitutions being preferred, as discussed below.

Also included within the definition of variant TR proteins of the present invention are amino acid sequence variants of the variant TR sequences outlined herein and shown in the Figures. That is, the variant TR proteins may contain additional variable positions as compared to human TR. These variants fall into one or more of three classes: substitutional, insertional or deletional variants. These variants ordinarily are prepared by site specific mutagenesis of nucleotides in the DNA encoding a variant TR protein, using cassette or PCR mutagenesis or other techniques well known in the art, to produce DNA encoding the variant, and thereafter expressing the DNA in recombinant cell culture as outlined above. However, variant TR protein fragments having up to about 100–150 residues may be prepared by in vitro synthesis using established techniques. Amino acid sequence variants are characterized by the predetermined nature of the variation, a feature that sets them apart from naturally occurring allelic or interspecies variation of the variant TR protein amino acid sequence. The variants typically exhibit the same qualitative biological activity as the naturally occurring analogue; although variants can also be selected which have modified characteristics as will be more fully outlined below.

While the site or region for introducing an amino acid sequence variation is predetermined, the mutation per se need not be predetermined. For example, in order to optimize the performance of a mutation at a given site, random mutagenesis may be conducted at the target codon or region and the expressed variant TR proteins screened for the optimal combination of desired activity. Techniques for making substitution mutations at predetermined sites in DNA having a known sequence are well known, for example, M13 primer mutagenesis and PCR mutagenesis. Screening of the mutants is done using assays of variant TR protein activities.

Amino acid substitutions are typically of single residues; insertions usually will be on the order of from about 1 to 20 amino acids, although considerably larger insertions may be tolerated. Deletions range from about 1 to about 20 residues, although in some cases deletions may be much larger.

Substitutions, deletions, insertions or any combination thereof may be used to arrive at a final derivative. Generally these changes are done on a few amino acids to minimize the alteration of the molecule. However, larger changes may be tolerated in certain circumstances. When small alterations in the characteristics of the variant TR protein are desired, substitutions are generally made in accordance with the following chart:

CHART I

| Original Residue | Exemplary Substitutions |
|---|---|
| Ala | Ser |
| Arg | Lys |
| Asn | Gln, His |
| Asp | Glu |
| Cys | Ser, Ala |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

Substantial changes in function or immunological identity are made by selecting substitutions that are less conservative than those shown in Chart I. For example, substitutions may be made which more significantly affect: the structure of the polypeptide backbone in the area of the alteration, for example the alpha-helical or beta-sheet structure; the charge or hydrophobicity of the molecule at the target site; or the bulk of the side chain. The substitutions which in general are expected to produce the greatest changes in the polypeptide's properties are those in which (a) a hydrophilic residue, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine.

The variants typically exhibit the same qualitative biological activity and will elicit the same immune response as the original variant TR protein, although variants also are selected to modify the characteristics of the variant TR proteins as needed. Alternatively, the variant may be designed such that the biological activity of the variant TR protein is altered. For example, glycosylation sites may be altered or removed. Similarly, the biological function may be altered; for example, in some instances it may be desirable to have more or less potent TR activity.

The variant TR proteins and nucleic acids of the invention can be made in a number of ways. Individual nucleic acids and proteins can be made as known in the art and outlined below. Alternatively, libraries of variant TR proteins can be made for testing.

In a preferred embodiment, sets or libraries of variant TR proteins are generated from a probability distribution table. As outlined herein, there are a variety of methods of generating a probability distribution table, including using PDA, sequence alignments, forcefield calculations such as SCMF calculations, etc. In addition, the probability distribution can be used to generate information entropy scores for each position, as a measure of the mutational frequency observed in the library.

In this embodiment, the frequency of each amino acid residue at each variable position in the list is identified. Frequencies can be thresholded, wherein any variant frequency lower than a cutoff is set to zero. This cutoff is preferably 1%, 2%, 5%, 10% or 20%, with 10% being particularly preferred. These frequencies are then built into the variant TR library. That is, as above, these variable positions are collected and all possible combinations are generated, but the amino acid residues that "fill" the library are utilized on a frequency basis. Thus, in a non-frequency based library, a variable position that has 5 possible residues will have 20% of the proteins comprising that variable position with the first possible residue, 20% with the second, etc. However, in a frequency based library, a variable position that has 5 possible residues with frequencies of 10%, 15%, 25%, 30% and 20%, respectively, will have 10% of the proteins comprising that variable position with the first possible residue, 15% of the proteins with the second residue, 25% with the third, etc. As will be appreciated by those in the art, the actual frequency may depend on the method used to actually generate the proteins; for example, exact frequencies may be possible when the proteins are synthesized. However, when the frequency-based primer system outlined below is used, the actual frequencies at each position will vary, as outlined below.

As will be appreciated by those in the art and outlined herein, probability distribution tables can be generated in a variety of ways. In addition to the methods outlined herein, self-consistent mean field (SCMF) methods can be used in the direct generation of probability tables. SCMF is a deterministic computational method that uses a mean field description of rotamer interactions to calculate energies. A probability table generated in this way can be used to create libraries as described herein. SCMF can be used in three ways: the frequencies of amino acids and rotamers for each amino acid are listed at each position; the probabilities are determined directly from SCMF (see Delarue et la. Pac. Symp. Biocomput. 109–21 (1997), expressly incorporated by reference). In addition, highly variable positions and non-variable positions can be identified. Alternatively, another method is used to determine what sequence is jumped to during a search of sequence space; SCMF is used to obtain an accurate energy for that sequence; this energy is then used to rank it and create a rank-ordered list of sequences (similar to a Monte Carlo sequence list). A probability table showing the frequencies of amino acids at each position can then be calculated from this list (Koehl et al., J. Mol. Biol. 239:249 (1994); Koehl et al., Nat. Struc. Biol. 2:163 (1995); Koehl et al., Curr. Opin. Struct. Biol. 6:222 (1996); Koehl et al., J. Mol. Bio. 293:1183 (1999); Koehl et al., J. Mol. Biol. 293:1161 (1999); Lee J. Mol. Biol. 236:918 (1994); and Vasquez Biopolymers 36:53–70 (1995); all of which are expressly incorporated by reference. Similar methods include, but are not limited to, OPLS-AA (Jorgensen, et al., J. Am. Chem. Soc. (1996), v 118, pp 11225_11236; Jorgensen, W. L.; BOSS, Version 4.1; Yale University: New Haven, Conn. (1999)); OPLS (Jorgensen, et al., J. Am. Chem. Soc. (1988), v 110, pp 1657ff; Jorgensen, et al., J Am. Chem. Soc. (1990), v 112, pp 4768ff); UNRES (United Residue Forcefield; Liwo, et al., Protein Science (1993), v 2, pp1697–1714; Liwo, et al., Protein Science (1993), v 2, pp1715–1731; Liwo, et al., J. Comp. Chem. (1997), v 18, pp849_873; Liwo, et al., J. Comp. Chem. (1997), v 18, pp874–884; Liwo, et al., J. Comp. Chem. (1998), v 19, pp259–276; Forcefield for Protein Structure Prediction (Liwo, et al., Proc. Natl. Acad. Sci. USA (1999), v 96, pp5482–5485); ECEPP/3 (Liwo et al., J Protein Chem 1994 May; 13(4):375–80); AMBER 1.1 force field (Weiner, et al., J. Am. Chem. Soc. v106, pp765–784); AMBER 3.0 force field (U. C. Singh et al., Proc. Natl. Acad. Sci. USA. 82:755–759); CHARMM and CHARMM22 (Brooks, et al., J. Comp. Chem. v4, pp 187–217); cvff3.0 (Dauber-Osguthorpe, et al.,(1988) Proteins: Structure, Function and Genetics, v4,pp31–47); cff91 (Maple, et al., J. Comp. Chem. v15, 162–182); also, the DISCOVER (cvff and cff91) and AMBER forcefields are used in the INSIGHT molecular modeling package (Biosym/MSI, San Diego Calif.) and HARMM is used in the QUANTA molecular modeling package (Biosym/MSI, San Diego Calif.).

In addition, as outlined herein, a preferred method of generating a probability distribution table is through the use of sequence alignment programs. In addition, the probability table can be obtained by a combination of sequence alignments and computational approaches. For example, one can add amino acids found in the alignment of homologous sequences to the result of the computation. Preferable one can add the wild type amino acid identity to the probability table if it is not found in the computation.

As will be appreciated, a variant TR library created by recombining variable positions and/or residues at the variable position may not be in a rank-ordered list. In some embodiments, the entire list may just be made and tested. Alternatively, in a preferred embodiment, the variant TR library is also in the form of a rank ordered list. This may be done for several reasons, including the size of the library is still too big to generate experimentally, or for predictive purposes. This may be done in several ways.

In one embodiment, the library is ranked using the scoring functions of PDA to rank the library members. Alternatively, statistical methods could be used. For example, the library may be ranked by frequency score; that is, proteins containing the most of high frequency residues could be ranked higher, etc. This may be done by adding or multiplying the frequency at each variable position to generate a numerical score. Similarly, the library different positions could be weighted and then the proteins scored; for example, those containing certain residues could be arbitrarily ranked.

In a preferred embodiment, the different protein members of the variant TR library may be chemically synthesized. This is particularly useful when the designed proteins are short, preferably less than 150 amino acids in length, with less than 100 amino acids being preferred, and less than 50 amino acids being particularly preferred, although as is known in the art, longer proteins can be made chemically or enzymatically. See for example Wilken et al, Curr. Opin. Biotechnol. 9:412–26 (1998), hereby expressly incorporated by reference.

In a preferred embodiment, particularly for longer proteins or proteins for which large samples are desired, the library sequences are used to create nucleic acids such as DNA which encode the member sequences and which can then be cloned into host cells, expressed and assayed, if desired. Thus, nucleic acids, and particularly DNA, can be made which encodes each member protein sequence. This is done using well known procedures. The choice of codons, suitable expression vectors and suitable host cells will vary depending on a number of factors, and can be easily optimized as needed.

In a preferred embodiment, multiple PCR reactions with pooled oligonucleotides is done, as is generally described in U.S. Ser. No. 09/927,790; incorporated herein by reference. In this embodiment, overlapping oligonucleotides are synthesized which correspond to the full length gene. Again, these oligonucleotides may represent all of the different amino acids at each variant position or subsets.

In a preferred embodiment, these oligonucleotides are pooled in equal proportions and multiple PCR reactions are performed to create full length sequences containing the combinations of mutations defined by the library. In addition, this may be done using error-prone PCR methods.

In a preferred embodiment, the different oligonucleotides are added in relative amounts corresponding to the probability distribution table. The multiple PCR reactions thus result in full length sequences with the desired combinations of mutations in the desired proportions.

The total number of oligonucleotides needed is a function of the number of positions being mutated and the number of mutations being considered at these positions:

(number of oligos for constant positions)+$M1$+$M2$+ $M3$+ ... $Mn$=(total number of oligos required), where $Mn$ is the number of mutations considered at position n in the sequence.

In a preferred embodiment, each overlapping oligonucleotide comprises only one position to be varied; in alternate embodiments, the variant positions are too close together to allow this and multiple variants per oligonucleotide are used to allow complete recombination of all the possibilities. That is, each oligo can contain the codon for a single position being mutated, or for more than one position being mutated. The multiple positions being mutated must be close in sequence to prevent the oligo length from being impractical. For multiple mutating positions on an oligonucleotide, particular combinations of mutations can be included or excluded in the library by including or excluding the oligonucleotide encoding that combination. For example, as discussed herein, there may be correlations between variable regions; that is, when position X is a certain residue, position Y must (or must not) be a particular residue. These sets of variable positions are sometimes referred to herein as a "cluster". When the clusters are comprised of residues close together, and thus can reside on one oligonucleotide primer, the clusters can be set to the "good" correlations, and eliminate the bad combinations that may decrease the effectiveness of the library. However, if the residues of the cluster are far apart in sequence, and thus will reside on different oligonucleotides for synthesis, it may be desirable to either set the residues to the "good" correlation, or eliminate them as variable residues entirely. In an alternative embodiment, the library may be generated in several steps, so that the cluster mutations only appear together. This procedure, i.e. the procedure of identifying mutation clusters and either placing them on the same oligonucleotides or eliminating them from the library or library generation in several steps preserving clusters, can considerably enrich the experimental library with properly folded protein. Identification of clusters can be carried out by a number of ways, e.g. by using known pattern recognition methods, comparisons of frequencies of occurrence of mutations or by using energy analysis of the sequences to be experimentally generated (for example, if the energy of interaction is high, the positions are correlated). These correlations may be positional correlations (e.g. variable positions 1 and 2 always change together or never change together) or sequence correlations (e.g. if there is residue A at position 1, there is always residue B at position 2). See: Pattern discovery in Biomolecular Data: Tools, Techniques, and Applications; edited by Jason T. L. Wang, Bruce A. Shapiro, Dennis Shasha. New York: Oxford University, 1999; Andrews, Harry C. Introduction to mathematical techniques in pattern recognition; New York, Wiley-Interscience [1972]; Applications of Pattern Recognition; Editor, K. S. Fu. Boca Raton, Fla. CRC Press, 1982; Genetic Algorithms for Pattern Recognition; edited by Sankar K. Pal, Paul P. Wang. Boca Raton: CRC Press, c1996; Pandya, Abhijit S., Pattern recognition with neural networks in C++/Abhijit S. Pandya, Robert B. Macy. Boca Raton, Fla.: CRC Press, 1996; Handbook of pattern recognition & computer vision/edited by C. H. Chen, L. F. Pau, P. S. P. Wang. 2nd ed. Singapore; River Edge, N.J.: World Scientific, c1999; Friedman, Introduction to Pattern Recognition: Statistical, Structural, Neural, and Fuzy Logic Approaches; River Edge, N.J.: World Scientific, c1999, Series title: Series in machine perception and artificial intelligence; vol. 32; all of which are expressly incorporated by reference. In addition, programs used to search for consensus motifs can be used as well.

In addition, correlations and shuffling can be fixed or optimized by altering the design of the oligonucleotides; that is, by deciding where the oligonucleotides (primers) start and stop (e.g. where the sequences are "cut"). The start and stop sites of oligos can be set to maximize the number of clusters that appear in single oligonucleotides, thereby enriching the library with higher scoring sequences. Different oligonucleotide start and stop site options can be computationally modeled and ranked according to number of clusters that are represented on single oligos, or the percentage of the resulting sequences consistent with the predicted library of sequences.

The total number of oligonucleotides required increases when multiple mutable positions are encoded by a single oligonucleotide. The annealed regions are the ones that remain constant, i.e. have the sequence of the reference sequence.

Oligonucleotides with insertions or deletions of codons can be used to create a library expressing different length proteins. In particular computational sequence screening for insertions or deletions can result in secondary libraries defining different length proteins, which can be expressed by a library of pooled oligonucleotide of different lengths.

In a preferred embodiment, the variant TR library is done by shuffling the family (e.g. a set of variants); that is, some set of the top sequences (if a rank-ordered list is used) can be shuffled, either with or without error_prone PCR. "Shuffling" in this context means a recombination of related sequences, generally in a random way. It can include "shuffling" as defined and exemplified in U.S. Pat. Nos. 5,830, 721; 5,811,238; 5,605,793; 5,837,458 and PCT US/19256, all of which are expressly incorporated by reference in their entirety. This set of sequences can also be an artificial set; for example, from a probability table (for example generated using SCMF) or a Monte Carlo set. Similarly, the "family" can be the top 10 and the bottom 10 sequences, the top 100 sequence, etc. This may also be done using error-prone PCR.

Thus, in a preferred embodiment, in silico shuffling is done using the computational methods described herein. That is, starting with either two libraries or two sequences, random recombinations of the sequences can be generated and evaluated.

In a preferred embodiment, error-prone PCR is done to generate the variant TR library. See U.S. Pat. Nos. 5,605, 793, 5,811,238, and 5,830,721, all of which are hereby incorporated by reference. This can be done on the optimal sequence or on top members of the library, or some other artificial set or family. In this embodiment, the gene for the optimal sequence found in the computational screen of the primary library can be synthesized. Error prone PCR is then performed on the optimal sequence gene in the presence of oligonucleotides that code for the mutations at the variant positions of the library (bias oligonucleotides). The addition of the oligonucleotides will create a bias favoring the incorporation of the mutations in the library. Alternatively, only oligonucleotides for certain mutations may be used to bias the library.

In a preferred embodiment, gene shuffling with error prone PCR can be performed on the gene for the optimal sequence, in the presence of bias oligonucleotides, to create a DNA sequence library that reflects the proportion of the mutations found in the variant TR library. The choice of the bias oligonucleotides can be done in a variety of ways; they can chosen on the basis of their frequency, i.e. oligonucleotides encoding high mutational frequency positions can be used; alternatively, oligonucleotides containing the most variable positions can be used, such that the diversity is increased; if the secondary library is ranked, some number of top scoring positions can be used to generate bias oligonucleotides; random positions may be chosen; a few top scoring and a few low scoring ones may be chosen; etc. What is important is to generate new sequences based on preferred variable positions and sequences.

In a preferred embodiment, PCR using a wild type gene or other gene can be used, as is generally described in U.S. Ser. No. 09/927,790; incorporated herein by reference. In this embodiment, a starting gene is used; generally, although this is not required, the gene is usually the wild type gene. In some cases it may be the gene encoding the global optimized sequence, or any other sequence of the list, or a consensus sequence obtained e.g. from aligning homologous sequences from different organisms. In this embodiment, oligonucleotides are used that correspond to the variant positions and contain the different amino acids of the library. PCR is done using PCR primers at the termini, as is known in the art. This provides two benefits; the first is that this generally requires fewer oligonucleotides and can result in fewer errors. In addition, it has experimental advantages in that if the wild type gene is used, it need not be synthesized.

In addition, there are several other techniques that can be used, as exemplified in the figures. In a preferred embodiment, ligation of PCR products is done.

In a preferred embodiment, a variety of additional steps may be done to the variant TR library; for example, further computational processing can occur, different variant TR libraries can be recombined, or cutoffs from different libraries can be combined. In a preferred embodiment, a variant TR library may be computationally remanipulated to form an additional variant TR library (sometimes referred to herein as "tertiary libraries"). For example, any of the variant TR library sequences may be chosen for a second round of PDA, by freezing or fixing some or all of the changed positions in the first library. Alternatively, only changes seen in the last probability distribution table are allowed. Alternatively, the stringency of the probability table may be altered, either by increasing or decreasing the cutoff for inclusion. Similarly, the variant TR library may be recombined experimentally after the first round; for example, the best gene/genes from the first screen may be taken and gene assembly redone (using techniques outlined below, multiple PCR, error prone PCR, shuffling, etc.).

Alternatively, the fragments from one or more good gene(s) to change probabilities at some positions. This biases the search to an area of sequence space found in the first round of computational and experimental screening.

In a preferred embodiment, a tertiary library can be generated from combining different variant TR-libraries. For example, a probability distribution table from a first variant TR library can be generated and recombined, either computationally or experimentally, as outlined herein. A PDA variant TR library may be combined with a sequence alignment variant TR library, and either recombined (again, computationally or experimentally) or just the cutoffs from each joined to make a new tertiary library. The top sequences from several libraries can be recombined. Sequences from the top of a library can be combined with sequences from the bottom of the library to more broadly sample sequence space, or only sequences distant from the top of the library can be combined. Variant TR libraries that analyzed different parts of a protein can be combined to a tertiary library that treats the combined parts of the protein.

In a preferred embodiment, a tertiary library can be generated using correlations in a variant TR library. That is, a residue at a first variable position may be correlated to a residue at second variable position (or correlated to residues at additional positions as well). For example, two variable positions may sterically or electrostatically interact, such that if the first residue is X, the second residue must be Y. This may be either a positive or negative correlation. variant library members, a variety of expression vectors are made. The expression vectors may be either self-replicating extrachromosomal vectors or vectors which integrate into a host genome. Generally, these expression vectors include transcriptional and translational regulatory nucleic acid operably linked to the nucleic acid encoding the library protein. The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice. The transcriptional and translational regulatory nucleic acid will generally be appropriate to the host cell used to express the library protein, as will be appreciated by those in the art; for example, transcriptional and translational regulatory nucleic acid sequences from Bacillus are preferably used to express the library protein in Bacillus. Numerous types of appropriate expression vectors, and suitable regulatory sequences are known in the art for a variety of host cells.

In general, the transcriptional and translational regulatory sequences may include, but are not limited to, promoter sequences, ribosomal binding sites, transcriptional start and stop sequences, translational start and stop sequences, and enhancer or activator sequences. In a preferred embodiment, the regulatory sequences include a promoter and transcriptional start and stop sequences.

Promoter sequences include constitutive and inducible promoter sequences. The promoters may be either naturally occurring promoters, hybrid or synthetic promoters. Hybrid promoters, which combine elements of more than one promoter, are also known in the art, and are useful in the present invention.

In addition, the expression vector may comprise additional elements. For example, the expression vector may have two replication systems, thus allowing it to be maintained in two organisms, for example in mammalian or insect cells for expression and in a prokaryotic host for cloning and amplification. Furthermore, for integrating expression vectors, the expression vector contains at least one sequence homologous to the host cell genome, and preferably two homologous sequences which flank the expression construct. The integrating vector may be directed to a specific locus in the host cell by selecting the appropriate homologous sequence for inclusion in the vector. Constructs for integrating vectors and appropriate selection and screening protocols are well known in the art and are described in e.g., Mansour et al., *Cell*, 51:503 (1988) and Murray, *Gene Transfer and Expression Protocols, Methods in Molecular Biology*, Vol. 7 (Clifton: Humana Press, 1991).

In addition, in a preferred embodiment, the expression vector contains a selection gene to allow the selection of transformed host cells containing the expression vector, and particularly in the case of mammalian cells, ensures the stability of the vector, since cells which do not contain the vector will generally die. Selection genes are well known in the art and will vary with the host cell used. By "selection gene" herein is meant any gene which encodes a gene product that confers resistance to a selection agent. Suitable selection agents include, but are not limited to, neomycin (or its analog G418), blasticidin S, histinidol D, bleomycin, puromycin, hygromycin B, and other drugs.

In a preferred embodiment, the expression vector contains a RNA splicing sequence upstream or downstream of the gene to be expressed in order to increase the level of gene expression. See Barret et al., Nucleic Acids Res. 1991; Groos et al., Mol. Cell. Biol. 1987; and Budiman et al., Mol. Cell. Biol. 1988.

A preferred expression vector system is a retroviral vector system such as is generally described in Mann et al., Cell, 33:153–9 (1993); Pear et al., Proc. Natl. Acad. Sci. U.S.A., 90(18):8392–6 (1993); Kitamura et al., Proc. Natl. Acad. Sci. U.S.A., 92:9146–50 (1995); Kinsella et al., Human Gene Therapy, 7:1405–13; Hofmann et al., Proc. Natl. Acad. Sci. U.S.A., 93:5185–90; Choate et al., Human Gene Therapy, 7:2247 (1996); PCT/US97/01019 and PCT/US97/01048, and references cited therein, all of which are hereby expressly incorporated by reference.

The candidate variant library proteins of the present invention are produced by culturing a host cell transformed with nucleic acid, preferably an expression vector, containing nucleic acid encoding an library protein, under the appropriate conditions to induce or cause expression of the library protein. The conditions appropriate for candidate variant library protein expression will vary with the choice of the expression vector and the host cell, and will be easily ascertained by one skilled in the art through routine experimentation. For example, the use of constitutive promoters in the expression vector will require optimizing the growth and proliferation of the host cell, while the use of an inducible promoter requires the appropriate growth conditions for induction. In addition, in some embodiments, the timing of the harvest is important. For example, the baculoviral systems used in insect cell expression are lytic viruses, and thus harvest time selection can be crucial for product yield.

As will be appreciated by those in the art, the type of cells used in the present invention can vary widely. Basically, a wide variety of appropriate host cells can be used, including yeast, bacteria, archaebacteria, fungi, and insect, plant, and animal cells, including mammalian cells. Of particular interest are *Drosophila melanogaster* cells, *Saccharomyces cerevisiae* and other yeasts, *E. coli, Bacillus subtilis*, SF9 cells, C129 cells, 293 cells, Neurospora, BHK, CHO, COS, and HeLa cells, fibroblasts, Schwanoma cell lines, immortalized mammalian myeloid and lymphoid cell lines, Jurkat cells, mast cells and other endocrine and exocrine cells, and neuronal cells. See the ATCC cell line catalog, hereby expressly incorporated by reference. In addition, the expression of the secondary libraries in phage display systems, such as are well known in the art, are particularly preferred, especially when the secondary library comprises random peptides. In one embodiment, the cells may be genetically engineered, that is, contain exogeneous nucleic acid, for example, to contain target molecules.

In a preferred embodiment, the candidate variant protein or candidate variant library proteins are expressed in mammalian cells. Any mammalian cells may be used, with mouse, rat, primate and human cells being particularly preferred, although as will be appreciated by those in the art, modifications of the system by pseudotyping allows all eukaryotic cells to be used, preferably higher eukaryotes. As is more fully described below, a screen will be set up such that the cells exhibit a selectable phenotype in the presence of a random library member. As is more fully described below, cell types implicated in a wide variety of disease conditions are particularly useful, so long as a suitable screen may be designed to allow the selection of cells that exhibit an altered phenotype as a consequence of the presence of a library member within the cell.

Accordingly, suitable mammalian cell types include, but are not limited to, tumor cells of all types (particularly melanoma, myeloid leukemia, carcinomas of the lung, breast, ovaries, colon, kidney, prostate, pancreas and testes), cardiomyocytes, endothelial cells, epithelial cells, lymphocytes (T-cell and B cell), mast cells, eosinophils, vascular intimal cells, hepatocytes, leukocytes including mononuclear leukocytes, stem cells such as haemopoetic, neural, skin, lung, kidney, liver and myocyte stem cells (for use in screening for differentiation and de-differentiation factors), osteoclasts, chondrocytes and other connective tissue cells, keratinocytes, melanocytes, liver cells, kidney cells, and adipocytes. Suitable cells also include known research cells, including, but not limited to, Jurkat T cells, NIH3T3 cells, CHO, Cos, etc. See the ATCC cell line catalog, hereby expressly incorporated by reference.

Mammalian expression systems are also known in the art, and include retroviral systems. A mammalian promoter is any DNA sequence capable of binding mammalian RNA polymerase and initiating the downstream (3') transcription of a coding sequence for library protein into mRNA. A promoter will have a transcription initiating region, which is usually placed proximal to the 5' end of the coding sequence, and a TATA box, using a located 25–30 base pairs upstream of the transcription initiation site. The TATA box is thought to direct RNA polymerase II to begin RNA synthesis at the correct site. A mammalian promoter will also contain an upstream promoter element (enhancer element), typically located within 100 to 200 base pairs upstream of the TATA box. An upstream promoter element determines the rate at which transcription is initiated and can act in either orientation. Of particular use as mammalian promoters are the promoters from mammalian viral genes, since the viral genes are often highly expressed and have a broad host range. Examples include the SV40 early promoter, mouse mammary tumor virus LTR promoter, adenovirus major late promoter, herpes simplex virus promoter, and the CMV promoter.

Typically, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-translational cleavage and polyadenylation. Examples of transcription terminator and polyadenlytion signals include those derived form SV40.

The methods of introducing exogenous nucleic acid into mammalian hosts, as well as other hosts, is well known in the art, and will vary with the host cell used. Techniques include dextran-mediated transfection, calcium phosphate precipitation, polybrene mediated transfection, protoplast fusion, electroporation, viral infection, encapsulation of the polynucleotide(s) in liposomes, and direct microinjection of the DNA into nuclei.

In a preferred embodiment, candidate variant proteins or candidate variant library proteins are expressed in bacterial systems. Bacterial expression systems are well known in the art.

A suitable bacterial promoter is any nucleic acid sequence capable of binding bacterial RNA polymerase and initiating the downstream (3') transcription of the coding sequence of library protein into mRNA. A bacterial promoter has a transcription initiation region which is usually placed proximal to the 5' end of the coding sequence. This transcription initiation region typically includes an RNA polymerase binding site and a transcription initiation site. Sequences encoding metabolic pathway enzymes provide particularly useful promoter sequences. Examples include promoter sequences derived from sugar metabolizing enzymes, such as galactose, lactose and maltose, and sequences derived from biosynthetic enzymes such as tryptophan. Promoters from bacteriophage may also be used and are known in the art. In addition, synthetic promoters and hybrid promoters are also useful; for example, the tac promoter is a hybrid of the trp and lac promoter sequences. Furthermore, a bacterial promoter can include naturally occurring promoters of non-bacterial origin that have the ability to bind bacterial RNA polymerase and initiate transcription.

In addition to a functioning promoter sequence, an efficient ribosome binding site is desirable. In *E. coli*, the ribosome binding site is called the Shine-Delgarno (SD) sequence and includes an initiation codon and a sequence 3–9 nucleotides in length located 3–11 nucleotides upstream of the initiation codon.

The expression vector may also include a signal peptide sequence that provides for secretion of the library protein in bacteria. The signal sequence typically encodes a signal peptide comprised of hydrophobic amino acids which direct the secretion of the protein from the cell, as is well known in the art. The protein is either secreted into the growth media (gram-positive bacteria) or into the periplasmic space, located between the inner and outer membrane of the cell (gram-negative bacteria).

The bacterial expression vector may also include a selectable marker gene to allow for the selection of bacterial strains that have been transformed. Suitable selection genes include genes which render the bacteria resistant to drugs such as ampicillin, chloramphenicol, erythromycin, kanamycin, neomycin and tetracycline. Selectable markers also include biosynthetic genes, such as those in the histidine, tryptophan and leucine biosynthetic pathways.

These components are assembled into expression vectors. Expression vectors for bacteria are well known in the art, and include vectors for *Bacillus subtilis*, *E. coli*, *Streptococcus cremoris*, and *Streptococcus lividans*, among others.

The bacterial expression vectors are transformed into bacterial host cells using techniques well known in the art, such as calcium chloride treatment, electroporation, and others.

In one embodiment, candidate variant protein are produced in insect cells. Expression vectors for the transformation of insect cells, and in particular, baculovirus-based expression vectors, are well known in the art and are described e.g., in O'Reilly et al., *Baculovirus Expression Vectors: A Laboratory Manual* (New York: Oxford University Press, 1994).

In a preferred embodiment, candidate variant protein is produced in yeast cells. Yeast expression systems are well known in the art, and include expression vectors for *Saccharomyces cerevisiae*, *Candida albicans* and *C. maltosa*, *Hansenula polymorpha*, *Kluyveromyces fragilis* and *K. lactis*, *Pichia guillerimondii* and *P. pastoris*, *Schizosaccharomyces pombe*, and *Yarrowia lipolytica*. Preferred promoter sequences for expression in yeast include the inducible GAL1, 10 promoter, the promoters from alcohol dehydrogenase, enolase, glucokinase, glucose-6-phosphate isomerase, glyceraldehyde-3-phosphate-dehydrogenase, hexokinase, phosphofructokinase, 3-phosphoglycerate mutase, pyruvate kinase, and the acid phosphatase gene. Yeast selectable markers include ADE2, HIS4, LEU2, TRP1, and ALG7, which confers resistance to tunicamycin; the neomycin phosphotransferase gene, which confers resistance to G418; and the CUP1 gene, which allows yeast to grow in the presence of copper ions.

In a preferred embodiment, the candidate variant protein or candidate variant library proteins are expressed in plant cells. Gene sequences intended for expression in transgenic plants are first assembled in expression cassettes adjacent to a suitable promoter expressible in plants. The expression cassettes may also include any further sequences required or selected for the expression of the transgene. Such sequences include, but are not restricted to, transcription terminators, extraneous sequences to enhance expression such as introns, enhancer sequences, and sequences intended for the targeting of the gene product to specific organelles and cell compartments. These expression cassettes can then be easily transferred to the plant transformation vectors described below. The following is a description of various components of typical expression cassettes.

The selection of the promoter used in expression cassettes determines the spatial and temporal expression pattern of the transgene in the transgenic plant. Selected promoters express transgenes in specific cell types (such as leaf epidermal cells, mesophyll cells, root cortex cells) or in specific tissues or organs (roots, leaves or flowers, for example) and the selection of a promoter is therefore based on the desired location of accumulation of the gene product. In a preferred embodiment of the invention, a seed-specific promoter is used for expression of an oleosin-TR fusion protein, an oleosin-TR fusion protein or an oleosin-hybrid TR/TR-reductase fusion protein. In a most preferred embodiment, the seed specific promoter is a phaseolin promoter.

Promoters vary in their ability to promote transcription. Depending upon the host cell system utilized, any one of a number of suitable promoters known in the art can be used. For constitutive expression, the CaMV 35S promoter, the rice actin promoter, or the ubiquitin promoter may be used. Alternatively, an inducible promoter may be selected to drive expression of the gene under various inducing conditions. For chemically inducible expression, the inducible PR-1 promoter from tobacco or *Arabidopsis* may be used (see, e.g., U.S. Pat. No. 5,689,044).

A variety of transcriptional terminators are available for use in nuclear gene expression cassettes, and are responsible for the termination of transcription beyond the transgene and its correct polyadenylation. Appropriate transcriptional terminators are those that are known to function in plants and include the CaMV 35S terminator, the tm/terminator, the nopaline synthase (nos) terminator and the pea rbcS E9 terminator. These can be used in both monocotyledonous and dicotyledonous plants. In a preferred embodiment, a phaseolin transcriptional terminator is used. Expression in plastids may not require termination, but may require correct 5' and 3' signals for translational initiation, elongation and RNA stability.

Numerous sequences have been found to enhance gene expression from within the transcriptional unit and these sequences can be used in conjunction with the genes of this invention to increase their expression in transgenic plants. For example, various intron sequences such as introns of the maize Adh1 gene have been shown to enhance expression, particularly in monocotyledonous cells. In addition, a number of non-translated leader sequences derived from viruses are also known to enhance expression, and these are particularly effective in dicotyledonous cells.

For their expression in transgenic plants, the coding sequence of DNA molecules used may require modification and optimization, particularly when the DNA molecules are of prokaryotic origin. It is known in the art that all organisms have specific preferences for codon usage, and the codons in the nucleotide sequence of the DNA molecules of the present invention can be changed to conform with specific plant preferences, while maintaining the amino acids encoded thereby. High expression in plants is best achieved from coding sequences which have at least 35% GC content, and preferably more than 45%. Nucleotide sequences which have low GC contents may express poorly due to the existence of ATTTA motifs which may destabilize messages, and AATAAA motifs which may cause inappropriate polyadenylation. Although preferred gene sequences may be adequately expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucl Acids Res* 17: 477–498). In addition, the nucleotide sequences are screened for the existence of illegitimate splice sites which cause message truncation. All changes required to be made within the nucleotide sequences such as those described above are made using well known techniques of site directed mutagenesis, PCR, and synthetic gene construction using, for example, the methods described in the published patent applications EP 0 385 962, EP 0 359 472, and WO 93/07278, the entire disclosures of which are hereby incorporated in their entireties.

For efficient initiation of translation, sequences adjacent to the initiating methionine may require modification. For example, they can be modified by the inclusion of sequences known to be effective in plants. Joshi has suggested an appropriate consensus for plants (*Nuc Acids Res* (1987) 15:6643–6653) and a further consensus translation initiator (*Clontech* 1993/1994 catalog, page 210) may be included. These consensus sequences are suitable for use with the nucleotide sequences of this invention. The sequences are incorporated into constructions including the nucleotide sequence, up to and including the ATG (whilst leaving the second amino acid unmodified), or alternatively up to and including the GTC subsequent to the ATG (with the possibility of modifying the second amino acid of the transgene).

Various mechanisms for targeting gene products are known to exist in plants, and the sequences controlling the functioning of these mechanisms have been characterized in some detail. For example, the targeting of gene products to the chloroplast is controlled by a transit sequence found at the amino terminal end of various proteins which is cleaved during chloroplast import to yield the mature protein (Comai et al. (1988) *J Biol Chem* 263: 15104–15109). Other gene products are localized to other organelles such as the mitochondrion and the peroxisome (Unger et al. (1989) *Plant Mol Biol* 13:411–418). The cDNAs encoding these products can be manipulated to target heterologous gene products to these organelles. In addition, sequences have been characterized which cause the targeting of gene products to other cell compartments.

Amino terminal sequences are responsible for targeting to the ER, the apoplast, and extracellular secretion from aleurone cells (Koehler & Ho (1990) *Plant Cell* 2:769–783). Additionally, amino terminal sequences in conjunction with carboxy terminal sequences are responsible for vacuolar targeting of gene products (Shinshi et al., (1990) *Plant Mol Biol* 14:357–368). By the fusion of the appropriate targeting sequences described above to transgene sequences of interest it is possible to direct the transgene product to the desired organelle or cell compartment.

In another preferred embodiment, the DNA molecules of this invention are directly transformed into the plastid genome. Plastid transformation technology is described extensively in U.S. Pat. Nos. 5,451,513, 5,545,817, 5,545,818 and 5,576,198; in PCT application nos. WO 95/16783 and WO 97/32977; and in McBride et. al., *Proc Natl Acad Sci USA* 91: 7301–7305 (1994), the entire disclosures of all of which are hereby incorporated by reference. In one embodiment, plastid transformation is achieved via biolistics, first carried out in the unicellular green alga *Chlamydomonas reinhardtii* (Boynton et al. (1988) *Science* 240: 1534–1537)) and then extended to *Nicotiana tabacum* (Svab et al. (1990) *Proc Natl Acad Sci USA* 87:8526–8530), combined with selection for cis-acting antibiotic resistance loci (spectinomycin or streptomycin resistance) or complementation of non-photosynthetic mutant phenotypes.

In other embodiment, tobacco plastid transformation is carried out by particle bombardment of leaf or callus tissue, or polyethylene glycol (PEG)-mediated uptake of plasmid DNA by protoplasts, using cloned plastid DNA flanking a selectable antibiotic resistance marker. The 1 to 1.5 kb flanking regions, termed targeting sequences, facilitate homologous recombination with the plastid genome and allow the replacement or modification of specific regions of the 156 kb tobacco plastid genome. Initially, point mutations in the plastid 16S rDNA and rps12 genes conferring resistance to spectinomycin and/or streptomycin were utilized as selectable markers for transformation (Svab et al. (1990) *Proc Natl Acad Sci USA* 87:8526–8530; Staub et al. (1992) *Plant Cell* 4:39–45, the entire disclosures of which are hereby incorporated by reference), resulting in stable homoplasmic transformants at a frequency of approximately one per 100 bombardments of target leaves. The presence of cloning sites between these markers allows creation of a plastid targeting vector for introduction of foreign genes (Staub et al. (1993) *EMBO J* 12:601–606, the entire disclosure of which is hereby incorporated by reference): Substantial increases in transformation frequency were obtained by replacement of the recessive rRNA or r-protein antibiotic resistance genes with a dominant selectable marker, the bacterial aadA gene encoding the spectinomycin-detoxifying enzyme aminoglycoside-3'-adenyltransferase (Svab et al. (1993) *Proc Natl Acad Sci USA* 90: 913–917, the entire disclosure of which is hereby incorporated by reference). Previously, this marker had been used successfully for high-frequency transformation of the plastid genome of the green alga *Chlamydomonas reinhardtii* (Goldschmidt-Clermont, M. (1991) *Nucl Acids Res* 19, 4083–4089, the entire disclosure of which is hereby incorporated by reference). Recently, plastid transformation of protoplasts from tobacco and the moss *Physcomitrella* has been attained using PEG-mediated DNA uptake (O'Neill et al. (1993) *Plant J* 3:729–738; Koop et al. (1996) *Planta* 199:193–201, the entire disclosures of which are hereby incorporated by reference).

Both particle bombardment and protoplast transformation are appropriate in the context of the present invention. Plastid transformation of oilseed plants has been successfully carried out in the genera *Arabidopsis* and *Brassica* (Sikdar et al. (1998) *Plant Cell Rep* 18:20–24; PCT Application WO 00/39313, the entire disclosures of which are hereby incorporated by reference).

A DNA molecule of the present invention is inserted into a plastid expression cassette including a promoter capable of expressing the DNA molecule in plant plastids. A preferred promoter capable of expression in a plant plastid is, for example, a promoter isolated from the 5' flanking region upstream of the coding region of a plastid gene, which may come from the same or a different species, and the native product of which is typically found in a majority of plastid types including those present in non-green tissues. Gene expression in plastids differs from nuclear gene expression and is related to gene expression in prokaryotes (Stern et al.

(1997) *Trends in Plant Sci* 2:308–315, the entire disclosure of which is hereby incorporated by reference).

Plastid promoters generally contain the −35 and −10 elements typical of prokaryotic promoters, and some plastid promoters called PEP (plastid-encoded RNA polymerase) promoters are recognized by an *E. coli*-like RNA polymerase mostly encoded in the plastid genome, while other plastid promoters called NEP promoters are recognized by a nuclear-encoded RNA polymerase. Both types of plastid promoters are suitable for the present invention. Examples of plastid promoters include promoters of clpP genes such as the tobacco clpP gene promoter (WO 97/06250, the entire disclosure of which is hereby incorporated by reference) and the *Arabidopsis* clpP gene promoter (U.S. application Ser. No. 09/038,878, the entire disclosure of which is hereby incorporated by reference). Another promoter capable of driving expression of a DNA molecule in plant plastids comes from the regulatory region of the plastid 16S ribosomal RNA operon (Harris et al., (1994) *Microbiol Rev* 58:700–754; Shinozaki et al. (1986) *EMBO J* 5:2043–2049, the entire disclosures of both of which are hereby incorporated by reference). Other examples of promoters capable of driving expression of a DNA molecule in plant plastids include a psbA promoter or am rbcL promoter. A plastid expression cassette preferably further includes a plastid gene 3' untranslated sequence (3' UTR) operatively linked to a DNA molecule of the present invention. The role of untranslated sequences is preferably to direct the 3' processing of the transcribed RNA rather than termination of transcription. Preferably, the 3' UTR is a plastid rps16 gene 3' untranslated sequence, or the *Arabidopsis* plastid psbA gene 3' untranslated sequence. In a further preferred embodiment, a plastid expression cassette includes a poly-G tract instead of a 3' untranslated sequence. A plastid expression cassette also preferably further includes a 5' untranslated sequence (5' UTR) functional in plant plastids, operatively linked to a DNA molecule of the present invention.

A plastid expression cassette is included in a plastid transformation vector, which preferably further includes flanking regions for integration into the plastid genome by homologous recombination. The plastid transformation vector may optionally include at least one plastid origin of replication. The present invention also encompasses a plant plastid transformed with such a plastid transformation vector, wherein the DNA molecule is expressible in the plant plastid. The invention also encompasses a plant or plant cell, including the progeny thereof, including this plant plastid. In a preferred embodiment, the plant or plant cell, including the progeny thereof, is homoplasmic for transgenic plastids.

Other promoters capable of driving expression of a DNA molecule in plant plastids include transactivator-regulated promoters, preferably heterologous with respect to the plant or to the subcellular organelle or component of the plant cell in which expression is effected. In these cases, the DNA molecule encoding the transactivator is inserted into an appropriate nuclear expression cassette which is transformed into the plant nuclear DNA. The transactivator is targeted to plastids using a plastid transit peptide. The transactivator and the transactivator-driven DNA molecule are brought together either by crossing a selected plastid-transformed line with and a transgenic line containing a DNA molecule encoding the transactivator supplemented with a plastid-targeting sequence and operably linked to a nuclear promoter, or by directly transforming a plastid transformation vector containing the desired DNA molecule into a transgenic line containing a DNA molecule encoding the transactivator supplemented with a plastid-targeting sequence operably linked to a nuclear promoter. If the nuclear promoter is an inducible promoter, in particular a chemically inducible promoter, expression of the DNA molecule in the plastids of plants is activated by foliar application of a chemical inducer. Such an inducible trans-activator-mediated plastid expression system is preferably tightly regulatable, with no detectable expression prior to induction and exceptionally high expression and accumulation of protein following induction. A preferred transactivator is, for example, viral RNA polymerase. Preferred promoters of this type are promoters recognized by a single sub-unit RNA polymerase, such as the T7 gene 10 promoter, which is recognized by the bacteriophage T7 DNA-dependent RNA polymerase. The gene encoding the T7 polymerase is preferably transformed into the nuclear genome and the T7 polymerase is targeted to the plastids using a plastid transit peptide. Promoters suitable for nuclear expression of a gene, for example a gene encoding a viral RNA polymerase such as the T7 polymerase, are described above and elsewhere in this application. Expression of DNA molecules in plastids can be constitutive or can be inducible, and such plastid expression can be also organ- or tissue-specific. Examples of various expression systems are extensively described in WO 98/11235, the entire disclosure of which is hereby incorporated by reference. Thus, in one aspect, the present invention utilized coupled expression in the nuclear genome of a chloroplast-targeted phage T7 RNA polymerase under the control of the chemically inducible PR-1a promoter, for example of the PR-1 promoter of tobacco, operably linked with a chloroplast reporter transgene regulated by T7 gene 10 promoter/terminator sequences, for example as described in as in U.S. Pat. No. 5,614,395 the entire disclosure of which is hereby incorporated by reference. In another embodiment, when plastid transformants homoplasmic for the maternally inherited TR genes are pollinated by lines expressing the T7 polymerase in the nucleus, F1 plants are obtained that carry both transgene constructs but do not express them until synthesis of large amounts of enzymatically active protein in the plastids is triggered by foliar application of the PR-1a inducer compound benzo(1,2,3)thiadiazole-7-carbothioic acid S-methyl ester (BTH).

In a preferred embodiment, two or more genes, for example TR genes, are transcribed from the plastid genome from a single promoter in an operon-like polycistronic gene. In a preferred embodiment, the operon-like polycistronic gene includes an intervening DNA sequence between two genes in the operon-like polycistronic gene. In a preferred embodiment, the DNA sequence is not present in the plastid genome to avoid homologous recombination with plastid sequences. In another preferred embodiment, the DNA sequence is derived from the 5' untranslated (UTR) region of a non-eukaryotic gene, preferably from a viral 5' UTR, preferably from a 5' UTR derived from a bacterial phage, such as a T7, T3 or SP6 phage. In a preferred embodiment, a portion of the DNA sequence may be modified to prevent the formation of RNA secondary structures in an RNA transcript of the operon-like polycistronic gene, for example between the DNA sequence and the RBS of the downstream gene. Such secondary structures may inhibit or repress the expression of the downstream gene, particularly the initiation of translation. Such RNA secondary structures are predicted by determining their melting temperatures using computer models and programs such a the "mfold" program version 3 (available from Zuker and Turner, Washington University School of Medicine, St-Louis, Mo.) and other methods known to one skilled in the art.

The presence of the intervening DNA sequence in the operon-like polycistronic gene increases the accessibility of the RBS of the downstream gene, thus resulting in higher rates of expression. Such strategy is applicable to any two or more genes to be transcribed from the plastid genome from a single promoter in an operon-like chimeric gene.

Numerous transformation vectors available for plant transformation are known to those of ordinary skill in the art, and the genes pertinent to this invention can be used in conjunction with any such vectors. Vector selection will depend upon the preferred transformation technique and the target species being transformed. For certain target species, different antibiotic or herbicide selection markers may be preferred.

Selection markers used routinely in transformation include the nptII gene, which confers resistance to kanamycin and related antibiotics (Messing & Vieirra. (1982) *Gene* 19:259–268; Bevan et al. (1983) *Nature* 304:184–187), the bar gene, which confers resistance to the herbicide phosphinothricin (White et al. (1990) *Nucl Acids Res* 18: 1062; Spencer et al. (1990) *Theor Appl Genet* 79:625–631), the hph gene, which confers resistance to the antibiotic hygromycin (Yanofsky, et al. (1992) *Gene* 117:161–167), the dhfr gene, which confers resistance to methotrexate (Bourouis et al., *EMBO J.* 7:1099–1104 (1983)), the EPSPS gene, which confers resistance to glyphosate (U.S. Pat. Nos. 4,940,935 and 5,188,642), and the mannose phosphate isomerase gene pmi which confers tolerance to normally phytotoxic sugar mannose (Negrotto, et al. (2000) *Plant Cell Rep* 19:798–803).

Many vectors are suitable for transformation using *Agrobacterium tumefaciens*. These typically carry at least one T-DNA border sequence and include vectors such as pBIN 19 (Bevan, (1984) *Nucl Acids Res*) and pXYZ. Typical vectors suitable for *Agrobacterium* transformation include the binary vectors pCIB200 and pCIB2001, as well as the binary vector pCIB1 0 and hygromycin selection derivatives thereof. (U.S. Pat. No. 5,639,949).

Transformation without the use of *Agrobacterium tumefaciens* circumvents the requirement for T-DNA sequences in the chosen transformation vector. Consequently, vectors lacking these sequences can be used as an alternative to vectors such as the T-DNA-containing vectors described above.

Transformation techniques that do not rely on *Agrobacterium* include transformation via particle bombardment, protoplast uptake for example PEG and/or electroporation, and microinjection. The choice of vector depends largely on the preferred selection for the species being transformed. Typical vectors suitable for non-*Agrobacterium* transformation include pCIB3064, pSOG1 9, and pSOG35. (U.S. Pat. No. 5,639,949).

Once the coding sequence of interest has been cloned into an expression system, it is transformed into a plant cell. Methods for transformation and regeneration of plants are well known in the art. For example, Ti plasmid vectors have been utilized for the delivery of foreign DNA, as well as direct uptake of DNA, liposomes, electroporation, microinjection, and microprojectiles. In addition, bacteria from the genus *Agrobacterium* can be utilized to transform plant cells.

Transformation techniques for dicotyledons are well known in the art and include *Agrobacterium*-based techniques and techniques that do not require *Agrobacterium*. Non-*Agrobacterium* techniques involve the uptake of exogenous genetic material directly by protoplasts or cells. This can be accomplished by PEG or electroporation mediated uptake, particle bombardment-mediated delivery, or microinjection. In each case the transformed cells are regenerated to whole plants using standard techniques known in the art.

Methods for transformation of many dicot and monocot species are well-known in the art. Preferred techniques include direct gene transfer into protoplasts using PEG or electroporation techniques, particle bombardment into callus tissue, as well as *Agrobacterium*-mediated transformation.

In addition, the candidate variant library protein may also be made as a fusion protein, using techniques well known in the art. For example, the variant protein may be fused to other proteins to increase expression or stabilize the protein. Similarly, other fusion partners may be used, such as antibodies, targeting sequences that allow localization of the library members into a subcellular or extracellular compartment of the cell, rescue sequences or purification tags, that allow the purification or isolation of either the library protein or the nucleic acids encoding them; stability sequences, which confer stability or protection from degradation, fusion proteins including reporter, detection and selection genes or proteins, or combinations of these, as well as linker sequences as needed.

In a preferred embodiment, the candidate variant proteins or candidate variant library proteins are purified or isolated after expression. Variant proteins may be isolated or purified in a variety of ways known to those skilled in the art depending on what other components are present in the sample. Standard purification methods include electrophoretic, molecular, immunological and chromatographic techniques, including ion exchange, hydrophobic, affinity, and reverse-phase HPLC chromatography, and chromatofocusing. Ultrafiltration and diafiltration techniques, in conjunction with protein concentration are also useful. For general guidance in suitable purification techniques, see Scopes, R., Protein Purification, Springer-Verlan, N.Y. (1982). The degree of purification necessary will vary depending on the use of the variant protein. In some instances, no purification will be necessary.

Once made, the variant TR proteins may be experimentally tested and validated in in vivo and in vitro assays. Suitable assays include primary and secondary screening assays and characterization of purified protein kinetic parameters, i.e., $K_{cat}$ and $K_m$ (See FIGS. 11 and 12).

Once made, the variant TR proteins and nucleic acids of the invention find use in a number of applications. In a preferred embodiment, the variant TRs are used to reduce the antigenicity of glutens in wheat, rye and barley.

In other embodiments, the variant TRs are used to reduce the disulfide bonds in toxic proteins, such as those found in snake venom, bees, scorpions and the bacterial neurotoxins tetanus and botulinum.

In a preferred embodiment, the variant TRs are used to reduce alternative substrates. Alternative useful substrates for thioredoxin reductases include a number of plant and mammalian proteins found to contain thioredoxin domains. For example, protein disulfide isomerase (PDI) contains two regions that exhibit internal sequence homology to thioredoxin. PDI is a substrate for thioredoxin reductase. Protein disulfide isomerases have been identified from mammalian sources, such as bovine (Yamauchi et al., Biochem. Biophys. Res. Commun. 146:1485–1492, 1987), chicken (Parkkonen et al., Biochem. Zn 256:1005–1011, 1988), human (Rapilajaniemi et al. EMBO J. 6:643–649 1987), mouse (Gong, et al., Nucleic Acids Res. 16:1203, 1988), rabbit (Fliegel et al., J. Biol. Chem. 265:15496–15502, 1990), and rat (Edman et al., Nature 317:267–270, 1985). PDI has been isolated from yeast (Tachikawa et al., J. Biochem. 110:306–313). Suitable PDIs can be found in WO9501425 published 19950112 and WO9500636 published 19950105, as well as other PDIs known in the art including human and plant forms.

Compositions and uses of redox agents that are substrates of thioredoxin reductase, such as thioredoxin and PDI, are known in the art, and are discussed herein. Disulfide linkages are present in many types of proteins such as enzymes, structural proteins, etc. Enzymes are catalytic proteins such as proteases, amylases, etc., while structural proteins can be scleroproteins such as keratin, etc. Protein material in hair, wool, skin, leather, hides, food, fodder, is stains, and human tissue contains disulfide linkages. Treatment of some of these materials with PDI and thioredoxin, and a redox partner have been described previously. By way of example, the use of thioredoxin for waving, straightening, removing and softening of human and animal hair is described EP 183506 and WO8906122. U.S. Pat. No. 4,771,036 also describes the use of thioredoxin for prevention and reversal of cataracts. Use of thioredoxin to prevent metal catalysed oxidative damage in biological reactions is described by Pigiet et al. in EP 237189. EP 272781 and EP 276547 describe the use of PDI for reconfiguration of human hair, and for treatment of wool, respectively. The uses of such enzymes have all been connected with reduction of protein disulfide linkages to free protein sulhydryl groups and/or the rearrangement of disulfide linkages in the same or between different polypeptides. Consequently, thioredoxin reductases of the invention can be added to such compositions as a redox partner, optionally with its cofactor NADH or NADPH, to regenerate the redox agent and thus enhance the compositions' usefulness. In an alternative embodiment, the thioredoxin variant of the invention are provided as protein fusions with the redox agent as taught herein For example, the compositions can be used for the treatment or degradation of scleroproteins, especially hair, skin and wool, dehairing and softening of hides, treatment and cleaning of fabrics, as additives to detergents, thickening and gelation of food and fodder, strengthening of gluten in bakery or pastry products, and as pharmaceuticals for the alleviation of eye sufferings. The compositions of the invention, particularly with PDI, can be used with other protein containing materials to generate intermolecular protein disulfide cross-links yielding high molecular weight or gelled compositions. Thus the present invention can be used in the field of food processing such as of raw fish meat paste, kamaboko (fish cake), fish/livestock meat sausage, tofu (soy bean curd), noodles, confectionery, bread, dough, food adhesives, sheet-like meat food, yogurt, jelly and cheese. In addition, they can also be used as novel protein-derived materials in a wide range of industries including cosmetics, raw materials of microcapsules and carriers of immobilized enzymes.

In a preferred embodiment, variant TR-oleosin-thioredoxin and oleosin-variant thioredoxin-reductase fusion proteins accumulate in association with the oil bodies. In an alternate embodiment, oleosin-thioredoxin/variant thioredoxin-reductase hybrid fusion proteins accumulate in association with the oil bodies. The oil bodies can be fractionated to achieve partial purification of the fusion proteins. Purified oil bodies, with the associated fusion proteins, can be used as ingredients for testing of thioredoxin and thioredoxin-reductase activity and functional benefits in dermal (cosmetics) or food use applications. Oil bodies have very suitable processing and formulation characteristics for cosmetic and food ingredients. Therefore, delivery of thioredoxin and/or thioredoxin-reductase as oleosin fusions associated with oil bodies simplifies processing and increases product stability.

In an alternate embodiment, a second purification step can be performed to purify thioredoxin or thioredoxin-reductase from the oil bodies. This leads to a highly purified preparation of the proteins that can be used as an ingredient for testing the activity of thioredoxin and thioredoxin-reductase, and for providing functional benefits in cosmetics or food uses. See also U.S. patent Publication No. 2002/0037303; incorporated herein by reference.

In addition to other formulations and composition embodiments discussed herein, e.g, oil body embodiments, the compositions of the invention can contain soluble thioredoxin reductases and/or redox agents, and other ingredients known in the art as e.g. excipients, stabilizers, fillers, detergents, etc. The compositions can be formulated in any convenient form, e.g. as a powder, paste, liquid or in granular form. The enzyme(s) may be stabilized in a liquid by inclusion of enzyme stabilizers. Usually, the pH of a solution of the composition will be 5–10 and in some instances 7.0–8.5. Often a sterile composition is preferred depending on the use.

Additionally, grain and grain-derived product performance in livestock feed are also affected by inter- and intramolecular disulphide bonding. Grain digestibility, nutrient availability, and the neutralization of anti-nutritive factors (e.g., protease, arnylase inhibitors etc.) would be increased by reducing the extent of disulphide bonding (see WO 00/36126, filed 15 Dec. 1999). Expression of transgenic thioredoxin reductase variants, optionally with thioredoxin, in corn and soybeans and the use of thioredoxin reductase in grain processing, e.g., wet milling, provides an alternative method for reducing the disulfide bonds in seed proteins during or prior to industrial processing. The invention therefore provides grains with altered storage protein quality as well as grains that perform qualitatively differently from normal grain during industrial processing or animal digestion (both referred to subsequently as "processing"). This method of delivery of thioredoxin reductase, optionally with thioredoxin, eliminates the need to develop exogenous sources of thioredoxin and/or thioredoxin reductase for addition during processing. A second advantage to supplying thioredoxin and/or thioredoxin reductase via the grains is that physical disruption of seed integrity is not necessary to bring the enzyme in contact with the storage or matrix proteins of the seed prior to processing or as an extra processing step. The invention described herein is applicable to all grain crops, in particular corn, soybean, wheat, and barley, most particularly corn and soybean, especially corn. Expression of transgenic thioredoxin reductase, optionally with thioredoxin, in grain is a means of altering the quality of the material (seeds) going into grain processing, altering the quality of the material derived from grain processing, maximizing yields of specific seed components during processing (increasing efficiency), changing processing methods, and creating new uses for seed-derived fractions or components from milling streams. The invention thus provides a plant which expresses a thioredoxin reductase variant, optionally with thioredoxin, preferably under control of an inducible promoter, for example either operatively linked to the inducible promoter or under control of transactivator-regulated promoter wherein the corresponding transactivator is under control of the inducible promoter or is expressed in a second plant such that the promoter is activated by hybridization with the second plant; wherein the TR is preferably thermostable or a eukaryotic reductase; such plant also including seed therefor, which seed is optionally treated (e.g., primed or coated) and/or packaged, e.g. placed in a bag with instructions for use, and seed harvested therefrom, e.g., for use in a milling process as described above. The transgenic plant of the invention may optionally further comprise genes for enhanced production of NADPH or NADH.

The invention further provides a method for producing starch and/or protein comprising extracting starch or protein from seed harvested from a plant as described above; and a method for wet milling comprising steeping seed from a thioredoxin reductase-expressing plant as described above and extracting starch and/or protein therefrom. Heat stable enyzmes are preferred, such as from a thermophilic organism, e.g., from an archea, for example from *Methanococcus jannaschii* or *Archaeglobusfulgidus*, e.g., as described herein.

Expression of transgenic thioredoxin reductase variants, optionally with thioredoxin, in grain is also useful to improve grain characteristics associated with digestibility, particularly in animal feeds. Susceptibility of feed proteins to proteases is a function of time and of protein conformation. Kernel cracking is often used in feed formulation as is steam flaking. Both of these processes are designed to aid kernel digestibility. Softer kernels whose integrity can be disrupted more easily in animal stomachs are desirable. Conformational constraints and crosslinks between proteins are major determinants of protease susceptibility. Modifying these bonds by increased thioredoxin and/or thioredoxin reductase expression thereby aids digestion. Protein content and quality are important determinants in flaking grit production and in masa production. Reduction of disulphide bonds alters the nature of corn flour such that it is suitable for use as a wheat substitute, especially flours made from high-protein white corn varieties. Over half of the US soybean crop is crushed or milled, and the protein quality in the resulting low-fat soy flour or de-fatted soy flour (or soybean meal) is important for subsequent processing. Protein yield and quality from soybean processing streams are economically important, and are largely dependent upon protein conformation. Increasing thioredoxin activity through expression of transgenic thioredoxin and/or thioredoxin reductase increases protein solubility, and thus increases yield, in the water-soluble protein fractions. Recovery is facilitated by aqueous extraction of de-fatted soybean meal under basic conditions. Enhancing thioredoxin activity through expression of transgenic thioredoxin and/or thioredoxin reductase also reduces the required pH for efficient extraction and thereby reduces calcium or sodium hydroxide inputs, as well as lowering the acid input for subsequent acid precipitation, allowing efficient recovery of proteins without alkali damage, and reducing water consumption and processing plant waste effluents (that contain substantial biological oxygen demand loads). Protein redox status affects important functional properties supplied by soy proteins, such as solubility, water absorption, viscosity, cohesion/adhesion, gelation and elasticity. Fiber removal during soy protein concentrate production and soy protein isolate hydrolysis by proteases is enhanced by increasing thioredoxin activity as described herein. Similarly, as described for corn above, increasing thioredoxin activity through expression of transgenic thioredoxin and/or thioredoxin reductase enhances the functionality of enzyme-active soy flours and the digestibility of the soybean meal fraction and steam flaking fraction in animal feeds. Modification of protein quality during seed development and during processing are both provided, although it is preferred that the transgenic thioredoxin and/or thioredoxin reductase be targeted to a cell compartment and be thermostable, as described above, to avoid significant adverse effects on storage protein accumulation possibly encountered as a result of thioredoxmi activity during seed development. Alternately, the thioredoxin reductase variant, and optionally thioredoxin, can be added as a processing enzyme, (or as fusions as taught herein) as (in contrast to corn wet milling) breaking the disulphide bonds is not necessary until after grain integrity is destroyed (crushing and oil extraction). Protein disulfide isomerase (PDI) are also useful as described above for thioredoixn. Regarding use of oil bodies with TR, incorporated herein by reference is US20020037303 entitled "Thioredoxin and thioredoxin reductase containing oil body based products" published Mar. 28, 2002.

Additional uses of the enzymes of the invention for seed and gain can be found in WO0058453, published Oct. 5, 2000. Thioredoxin reductase variants can be expressed optionally with thioredoxin, or added exogenously, for the uses described therein for seed and grain quality enhancment. The transgenic plant of of interest include is barley, wheat, *Arabidopsis*, tobacco, rice, *Brassica*, Picea, or soy bean, maize, oat, rye, sorghum, millet, triticale, and forage and turf grass. A transgenic plant of the invention can have reduced allergenicity in comparison to the same part of a non-transgenic plant of the same species. The allergenicity can be hypersensitivity, wherein said hypersensitivity is reduced by at least 5%. Further, a transgenic plant of the invention can have increased digestibility in comparison to the same part of a non-transgenic plant of the same species. The digestibility is increased by at least 5 percent. A transgenic plant can have at least part of said plant having an earlier onset and/or an increased expression of a gibberellic acid inducible enzyme in comparison to the same part of a non-transgenic plant of the same species. Preferably the enzyme is pullulanase, alpha-amylase. The parts of the plant are preferably edible parts, more preferably grain or seed. Preferred promoters are a seed or grain maturation-specific promoter, e.g., selected from the group consisting of rice glutelins, rice oryzins, rice prolamines, barley hordeins, wheat gliadins, wheat glutelins, maize zeins, maize glutelins, oat glutelins, sorghum kasirins, millet pennisetins, rye secalins, and a maize embryo-specific globulin. In other embodiments are a food, feed or beverage product made from the transgenic seed or grain of the invention. The food, feed, or beverage can be flour, dough, bread, pasta, cookies, cake, thickener, beer, malted beverage, or a food additive. The food, feed, or beer product of can have reduced allergenicity and/or increased digestibility. Further, a dough product can have increased strength and volume in comparison to a dough made from a non-transgenic seed or grain of the same species. The food, feed, or beverage can have hyperdigestible protein and/or hyperdigestible starch. The food, feed, or beverage can be hypoallergenic. The above embodiments are also achieved by exogenous addition of the enzymes of the invention, as would e known in the art. It has been shown that reduction of disulfide protein allergens in wheat and milk by thioredoxin decreases their allergenicity. Thioredoxin treatment also increases the digestibility of the major allergen of milk (beta-lactoglobulin), as well as other disulfide proteins. A more detailed discussion of the benefits of adding exogenous thioredoxin to food products is presented in U.S. Pat. No. 5,792,506, which is specifically incorporated herein by reference. The compositions and methods can be enhanced using the TR variants of the invention.

As discussed herein, the proteins of the invention can be used to reduce allergenicity of proteins in food and feed. For example, see U.S. Pat. No. 6,190,723 and reference therein, which is specifically incorporated herein by reference, for uses of thioredoxin with thioredoxin reductase and NADPH as exogenously added treatments. Skin tests and feeding experiments carried out with sensitized dogs showed that treatment of their food prior to ingestion eliminated or decreased the allergenicity of the food.

Consequently, provided herein are compositions for and methods of decreasing the allergenicity of an allergenic food or feed protein. The food or feed protein or food or fed containing the protein or proteins is contacted with an amount of thioredoxin, thioredoxin reductase, and cofactor, namely NADPH, NADH or combination thereof, effective for decreasing the allergenicity of the protein. This can be followed by administering the contacted protein to an animal or human, wherein the allergenic symptoms exhibited by the animal or huamn are decreased as compared to a control. The allergenic food/feed protein is preferably from the beef, cow's milk, egg, soy, rice and wheat proteins. Also embodied are ingestible food/feed products containing thioredoxin and TR variant and further containing cofactor. The enzymes made be exogenously added, or one or the other may be transgenically or naturally present, singly or as a fusion. The ingestible food is preferably hypoallergenic because of the treatment. The food product can be a pet food or baby food or formula. The food product can contain beef, egg, soy, wheat or milk protein. It can be an ingestible meat food product. U.S. Pat. No. 5,792,506 is and its references are incorporated by reference.

Similarly, in U.S. Pat. No. 6,114,504 compositions and methods of reducing cystine containing animal and plant proteins, and improving dough and baked goods' characteristics is provided which includes the steps of mixing dough ingredients with a thiol redox protein to form a dough and baking the dough to form a baked good. The method of the present invention preferably uses reduced thioredoxin with wheat flour which imparts a stronger dough and higher loaf volumes. The methods and compositons are enhanced using the proteins of the invention. A method of reducing a glutenin or gliadin protein is by adding thioredoxin to a liquid or substance containing said glutenin or gliadin protein; reducing the thioredoxin by means of thioredoxin reductase variant and a cofactor, namely NADPH, NADH or combination thereof, and reducing the glutenin or gliadin protein by the reduced thioredoxin. A composition contains a glutenin or gliadin protein, added or endogenous thioredoxin, added or endogenous (as from a transgenic plant) thioredoxin reductase variant, and added cofactor, namely NADPH, NADH or combination thereof. The method is useful to reduce any water insoluble or soulble, seed-derived protein comprising. One can add thioredoxin to a liquid or substance containing said protein; reducing the thioredoxin by means of thioredoxin reductase variant and its cofactor, namely NADPH, NADH or combination thereof.

The invention is also useful for increasing hyperdigestibilty of food and feed proteins. See U.S. Pat. No. 5,952,034 that provides for compostions and methods to increase the digestibility of food proteins by thioredoxin reduction. The mehods are enhanced by use fo the enzymes of the invention. Compsotions and method of increasing the digestibility of a food comprise treating a food with an amount of thioredoxin, thioredoxin reductase variant, and its cofactor, namely NADPH, NADH or combinatio thereof, effective for increasing the digestibility of the food; and optionally administering the treated food to an animal or human thereby increasing the digestibility of the food as measured by the symptoms exhibited by said animal or human as compared to a control. The food preferably contains milk or wheat or eggs. In the above embodiments, the thioredxoin reductase variant can be provided as a protein fusion with thioredoxin.

The compositions of the invention also find additional uses. Thioredoxin and other redox agents, such as PDI, are known to be useful in protection against stress and injury. Accordingly, the compositons of the invention can be usd to enhance redox agent compositins for such treatment. In one embodiment, TR variants are used to manipulate nitrosative stress to upregulate nitrosative stress defenses. See U.S. Pat. No. 6,359,004. Thioredoxin can act as a radical scavenger, thus disease and conditions related to free radicals can be treated with TR variants, preferably in combination with thioredoxin. Thus, in one aspect, the present invention provides compositions and methods for the prevention or treatment of eye diseases, such as cataracts. In another aspect, the present invention relates to the prevention or treatment of diseases caused by oxidative stress or having oxidative stress as a component. See for example U.S. Pat. No. 6,379,664. In one embodiment is provided compositions and methods of inhibiting or reversing the formation of a cataract in an eye, by contacting the eye with an effective cataract-inhibiting amount of a composition of the invention, containing TR variant, preferably in combination with thioredoxin. In another embodiment, intraocular injection of thioredoxin in combination of a TR variant and cofactor suppresses retinal photooxidative stress, and as a therapeutic strategy to prevent retinal photic injury. In another embodiment, compostions of the invention containing thioredoxin activity are useful to treat or minimize oxidative stress and ischemia-reperfusion induced in acute lung injury. And consequently further finds use in lung transplantation, particularly in patients with end-stage lung diseases, such as cystic fibrosis, emphysema, pulmonary fibrosis, and pulmonary hypertension. The compositions of the invention find use as storage compositions to maintain integrity of organs for transplant. In another embodiment, thioredoxin in combination with the TR variants promotes the in vitro survival of primary cultured neurons. Further the compositions will provide a neuroprotective effect in the penumbra to modify neuronal damage during focal brain ischemia. The compositions will also provide protection and improvement of motorneurons from or after nerve injury. In another embodiment, compositions of the invention protect the retina from ischemia-reperfusion injury. Burn injuries can also be treated with compositons of the invention. Thioredoxin and TR variants provide a rapid antioxidant defense, improves coagulation processes, cell growth, and control of the extracellular peroxide tone intimately linked to cytoprotection and wound healing in burns. Finally, the compositions of the invention provide thiol-antioxidants that are good candidates for controlling Epstein-Barr virus (EBV) infection.

TR variants can provide direct benefit by removing deleterious ascorbyl free radical and dehydroascorbate, which are reduced to ascorbic acid by thioredoxin reductase. Thus TR provides a direct antioxidant effect and treatment. The compositions can optionally contain cofactors.

In the diseases and conditions described herein, the TR variants can be supplied alone or in combination with thioredoxin or other redox agents and cofactors. The enzymes by be separate or fused. The TR variant may act with host redox agents or redox agnet can be exogenously added.

The following examples serve to more fully describe the manner of using the above-described invention, as well as to set forth the best modes contemplated for carrying out various aspects of the invention. It is understood that these examples in no way serve to limit the true scope of this invention, but rather are presented for illustrative purposes. All references cited herein, including U.S. Ser. No. 60/289,029, filed May 4, 2001, U.S. Ser. No. 60/370,609, filed Apr. 5, 2002, and the provisional application by Desjarlais and Muchhal, entitled "Novel Nucleic Acids and Proteins with Thioredoxin Reductase Activity", filed Apr. 29, 2002, serial number not assigned, are incorporated by reference.

EXAMPLES

Example 1

Computational Design of Variant Proteins

Overview

The initial PDA™ design strategy for creating variants with improved NADH-dependent TR activity is detailed below. In short, the structural information from both *E coli* and *Arabidopsis* enzymes, and the co-factor conformation diversity was used to design two different libraries (referred to as TR-1 and TR-2 henceforth), each with ~2000 combinatorial members.

Wilditype TR genes used as scaffold proteins:
1) *Arbidopsis* NTR1 gene cloned in pET29a . The encoded protein has an N-terminal S-tag. The protein may be expressed using BL21-S1 cells (salt induced) or BL21-Star (IPTG induced), lysed using BugBuster HT.
2) Thioredoxin j. A codon-optimized gene synthesized and cloned in pDEST-14, expressed in BL21-S1-Star. Solube fraction used as substrade during primary screenings. N- and/or C-terminal His tagged versions made. The C-terminal His-tagged TRx purified by affinity chromatograph for use in kinetic determinations.

Assay: Kinetic assay based on continuous detection of formation reducted product of DTNB at 412 nm.

A more detailed overview of the screening strategy used for identification and kinetic characterization of "hits" is described in FIG. 4.

Purified proteins were used for all the kinetic characterizations and second and third tier screenings. High throughput procedures for generating required amounts of purified proteins were either independently developed or adapted from existing commercial protocols. A snapshot of these methods is presented in FIG. 5. The detailed protocols used for high-throughput culture, induction, expression, protein purification and enzymatic characterization are described below.

The kinetic parameters (Km and Kcat) for the purified WT NTR-1 enzyme (unmodified) with respect to both the NADH and NADPH substrates to define the benchmark for PDA™ designed variants. The WT enzyme has ~4 fold higher Kcat (equivalent to the Vmax using 1 ug of TR protein) for the native (NADPH) co-factor than NADH. Also the Km is ~50 fold higher for NADH compared to NADPH. The data for WT enzyme is presented in FIG. 6.

The TR Libraries were constructed using standard molecular biology procedures of site-directed mutagenesis and recursive PCR. Combinatorial pieces representing specifically mutated gene segments were joined together using specific restriction enzymes. The quality of these libraries was evaluated from sequence and expression analysis of randomly picked clones. These details for the TR-1 and TR-2 are presented in FIGS. 7 and 8 respectively. In addition to these combinatorial libraries, individual C-region combinations for each of these two libraries (24 for TR-1 and 48 for TR-2) were synthesized in WT backbone to evaluate the effect of this critical region identified by PDA™, these clones are henceforth referred to as "defined clones" along with the individual members of TR-3 and TR4 (see below).

A computationally relevant description of the two libraries is presented in FIGS. 9A and B. The designed positions (orange) and the docked co-factor (blue or yellow) with appropriate conformation are identified.

In addition to these two libraries, a couple of very small libraries were generated to explore additional strategies. TR-3 had 18 members and was designed as a fine tuning approach based on results for the best clone from TR-2 screening. TR4 had 16 members and was based on sequence alignment of TR and AhpF sequence. AhpF codes for a NADH dependent peroxiredoxin reductase, an activity analogous to TR.

The summary of results from the screening of these 4 libraries is presented in FIG. 10.

The screening of TR-1 library did not identify any clones with significantly improved TR activity with NADH as a co-factor, compared to WT NTR-1. This likely the result of using the "incorrect" co-factor conformation.

The TR-2 library had several clones with significantly improved NADH-dependent activities. Two of the best variants with different C-regions sequences were "RYN" and "RFN". Mutations in other designed positions did not have a significant effect on the overall properties of the TR enzymes. The following slides present detailed kinetic data for many of these variants.

M-RYN, L-RYN and WT kinetic parameters and their activities at different co-factor concentrations are described FIGS. 11A and B respectively. Both of these variants have significantly higher NADH-dependent activities compared to WT. In addition they have significantly reduced NADPH dependent activity. This is termed "Co-factor Switch". At co-factor concentrations of 2.5 mM and above both of these PDA™ designed NTRs have >50% of WT NADPH activity with NADH as co-factor.

The sequence alignment of these clones and their relative computational ranking from the design perspective is shown in FIG. 17A.

The presence of N in RYN and RFN clones created a potential glycosylation site. This site was "designed out" using PDA™ without affecting the activity profile of these clones significantly. The data and strategy for this is described below.

Computational representation of the critical RRR to RYN change is described in FIG. 18.

In addition to RYN and RFN combinations in the C-region, REN, RLN, RRN combinations also had significantly improved NADH-dependent activity. The RRN variant also maintained its WT level of NADPH dependent activity. This data is summarized in FIG. 12. Additionally, RRT, RYT, RLR, KYN, MYN, QYN C-region variants also showed improved NADH-dependent activity.

The results from screening of these libraries point strongly to the significance of three RRR residues in the C-region for determining the co-factor specificity profile. To address the significance of all possible combinations of 20 amino acids at each of these positions, a high complexity random RRR library was designed and screened to identify the best variants for their activity with NADH. An oligonucleotide with NNK degeneracy at each of the three R positions was used to construct this library with a theoretical combinatorial potential of 32768 members.

After screening only a small proportion of this library, the sequence and activity analysis of the best clones indicated that a R to W mutation at the first R postion had the most interesting activity profile. This is also substantiated from the bioinformatics analysis of most naturally occurring NAD(P)H dependent enzymes sequences suggesting the presence of an aromatic amino acid. This led us to design a PDA™ library where the first R is forced to be an aromatic amino acid during PDA™ simulations. This led to the design of two additional smaller PDA™ libraries called R1-W and WXX. The computational strategy for their design is described below.

The best hits from all these new library designs were analyzed (using purified enzymes) for their relative activity at 0.6 and 1.2 mM each of the two co-factors. Their Km and Kcats were also determined and the data is presented in FIGS. 13A and B respectively.

These clones have "highly improved" NADH dependent TR activities. In addition to their improved NADH activity, some of the variants also have improved NADPH dependent activities. This in essence represents creating TR variants with better catalytic efficiencies for both the co-factors. This is also reflected in the several fold higher NADH Kcat values for all the variants. The Km for NADH remained unchanged for most of the improved variants, except WRT which has a two fold reduced Km for this co-factor. The members of this list coming from either R1-W and WXX libraries are indicated in FIG. 13C. A computational model of the two best clones from R1-W library are depicted in FIG. 14 for a structural perspective on their activity.

The PDA™ Design process for TR has thus identified:
Five or more variants with equal to or better than 50% of WT NADPH activity, with NADH at 1.2 mM.
At least one variant meets this activity milestone even at 0.6 mM NADH
A large number of these variant have improved catalytic efficiency for the NADPH activity also.
The best variant has a 13-fold better Kcat/Km and 2-fold lower Km for NADH compared to WT Thioredoxin Reductase R1-W Library A new set of PDA™ simulations was performed to evaluate the use of an aromatic amino acid (F, Y, or W) at the first position of the trio of residues discovered by Xencor to be extremely important in modulating activity levels with NADH and NADPH (corresponding to the position of R in the RYN variants). The new simulations were motivated by the observation that a small number of NAD(P)H utilizing enzymes contain an aromatic at this position, and the potential for a stacking interaction between the aromatic and the adenine ring on NAD(P)H.

Simulation of $20^{10}$ ($10^{13}$) sequences resulted in the library shown below, which defines 1296 variants for in vitro screening. The 10 positions were selected by structural analysis of critical residues for cofactor binding. Analysis of the simulation results revealed that sampling amino acid diversity at 6 of the 10 positions would result in a high-quality library of modest size.

The 4$^{th}$ PDA™ library, with diversity at 6 positions, in the context of W versus R at one position, is defined as:
LIRRRVI (wt)
LIWRTVI
AL ASIV
FV CN
EC
K
L
M
Q High throughput screening of this library yielded the following high activity WXX clones. These clones have been ranked computationally by performing PDA™ simulations that represent the 4$^{th}$ PDA™ combinatorial library.

Out of the 1296 possible sequences in this library the highly active WXX clones rank computationally as follows:
LIWRTVI 13/1296 (rank/library size)
LIWLSVI 51/1296
LIWMSVI 26/1296
LIWRSVI 46/1296

Note that these rankings are not intended to be predictive of relative activity: the calculation was designed to define the broadest set of structurally compatible cofactor binding pocket diversity in the smallest number of sequences. All of the library members are in the top 0.001% of the $20^6$ theoretically possible sequence combinations at the 6 positions included in the 4$^{th}$ library, demonstrating a focusing effect of over $10^4$. This furthermore constitutes a focusing effect of at least $10^9$ relative to the $20^{10}$ sequence combinations included in the original simulation.

Note also that these rankings are based purely on simulated interaction with NADH. They do not take into account the specificity of the enzyme for or against NADPH. Since the project objectives did not include NADPH/NADH specificity, comparative modeling of the two cofactor-protein complexes was not performed.

Additional Variants

Based on the success of the R1-W library, and the observation of considerable diversity at the 2$^{nd}$ and 3$^{rd}$ R positions in both the simulations and laboratory screening, Xencor constructed a small complexity (400) library to sample all possible WXX combinations. High throughput screening of this library led to the discovery of several additional variants with high activity using NADH, and variable activity using NADPH.

The 5 best clones from this library, containing diversity only at the 3 RRR positions, are listed below. While the design of this library was directly influenced by all of the previous PDA™ simulation and experimental results, the library was not based on a PDA™ simulation per se. Thus there are no computational rankings for these variants.
WIS
WFQ
WVR
WMG
WVG Computational Rankings of RYN Thioredoxin Reductase Variants The individual "RYN" clones have been ranked computationally by performing PDA™ simulations that represent the 2$^{nd}$ PDA™ combinatorial library constructed and screened by Xencor. Simulation of $20^8$ ($2.5\times10^{10}$) sequences resulted in the library below, which defines 2304 variants for in vitro screening. The 8 positions were selected by structural analysis of critical residues for cofactor binding.

The 2$^{nd}$ PDA™ library, with diversity at 8 positions is defined as:
LIGDRRRS
QMSNKYTD
L QEN
LI Out of the 2304 possible sequences in this library the wild-type and highly active RYN clones rank as follows:
LIGDRRRS (wt) 329
LIGDRYNS 339
LLGDRYNS 698
LMGDRYNS 920

Note that the rankings are not intended to be predictive of relative activity: the calculation was designed to define the broadest set of structurally compatible cofactor binding pocket diversity in the smallest number of sequences. All of the library members are in the top 0.00001% of the $20^8$ theoretically possible sequence combinations at the eight positions included in the $2^{nd}$ library, demonstrating a focusing effect of over $10^7$.

Note also that these rankings are based purely on simulated interaction with NADH. They do not take into account the specificity of the enzyme for or against NADPH. Since the project objectives did not include NADPH/NADH specificity, comparative modeling of the two cofactor-protein complexes was not performed.

Novel Thioredoxin Reductase Variants

Low Complexity Library. The initial success of the RYN variant motivated Xencor to pursue further optimization of this variant by refining the amino acids in the RYN variant, leading to the very small 18-member library shown below.
RRR
MYN
 FD Screening of this library revealed that the RFN combination was of similar activity to the RYN variants discovered previously. According to PDA™ simulations, this clone ranks $7^{th}$ in this library (RYN ranks $3^{rd}$).

Non-glycosylation variants. Because of the inadvertent introduction of a potential N-linked glycosylation site (consensus N-X-[T/S]) in the RYN and related variants (RYDAFNASKIMQQ), (SEQ ID NO:208), PDA™ simulations were performed to assess the feasibility of extinguishing the potential site by substitution of the Serine (S) two positions downstream of the Asn (N) in the RYN variants. The simulations indicate that several amino acid substitutions would be favorable, including Ser to Ala, which Xencor then produced and characterized experimentally. In this one-position simulation (NAX), Ala ranked $6^{th}$, with Thr and Ser ranked $1^{st}$ and $2^{nd}$, respectively. Experimental data indicates that the Ala substitution has no detectable effect on the activity of the RYN variants.
RYN-A (339/2304,6/20) (rank/original library size, rank/NAX library size)
RFN-A (7/18,6/20)

Computational Strategy

Primary Goal: Conversion of arabidopsis thioredoxin reductase activity such that it efficiently utilizes NADH vs. NADPH Basic Outline of Strategy:
I. generate starting model
  use *E coli* structure (1TDF) to "graft" coordinates of NADP cofactor into coordinate frame of arabidopsis structure (1VDC), which does not include cofactor coordinates.
II. define working cofactor conformation
  a. direct derivation by deleting P from NADP
  b. indirect derivation by superposition of NAD coordinates from various NAD-utilizing enzymes
III. run PDA simulation(s) to generate combinatorial library possibilities.
  a. define libray positions
  b. run simulation(s)
  c. generate library Detailed Outline of Strategy I. Generation of starting model
  A. The 1VDC structure file was processed to create a more reasonable numbering system for the structure (the original version contained an atypical numbering format so that the numbering agreed with the *E coli* structure).
  B. Structure alignment for grafting NADP coordinates from 1TDF to 1VDC
  An alignment was obtained using the C-alphas from the following residues: 117, 119, 151–156, 174–181, and 242–244. This gives an RMSD of 0.48 A for 19 matched atoms (with a maximum deviation of 0.89 A).
  C. Note that no minimization was done on the final model.

II: Defining the working cofactor conformations
  A. The initial cofactor conformation was defined simply by deleting the phosphate group from the NADP cofactor contained within the 1TDF file. We will refer to this conformation as NAD_TDF.
  B. Alternative NAD conformations.
  Adam Thomason developed Perl scripts that scan the PDB for structures containing NAD cofactors. The scripts then perform a full or partial superposition of the NAD from the extracted PDB file onto the reference NAD_TDF. A large number of NAD conformations were thus collected (see FIG. 19) and ready for use in PDA simulations.
  Simulations have been performed using either the NAD_TDF conformer or the NAD_GRB conformer (from 1GRB—human glutathione reductase), which had the lowest all-atom r.m.s.d to NAD_TDF. Visual inspection of over 100 NAD conformers indicates that the ribose pucker found in NAD_GRB is significantly more prevalent than that in NAD_TDF, suggesting that this conformer is of lower energy. It is possible that the rare conformer seen in NAD_TDF stems from the fact that this conformer was derived from NADP coordinates.
  C. Hydroxyl Rotamer States.
  The orientation of the hydrogen of a hydroxyl group can have a significant influence on side chain-cofactor interactions, particularly with respect to hydrogen bonding interactions. For library 1, a static pair of hydroxyl rotamers was utilized, because only a single ligand state can be included per simulation within the Xencor implementation of PDA™. Subsequently, the SPA package was developed such that a combinatorial set of ligand states can be included in the simulation. A support program named "makeligands" (from makeligands.f90) was also developed to generate combinatorial sets of hydroxyl rotamer orientations.

III. PDA Simulation(s) to Generate Combinatorial Libraries
  A Defining Library Positions
  The current strategy is to enhance interactions between the TRR protein and the adenine portion of NADH, particularly with the diol group on the adenine ribose, which is left behind when the phosphate is removed (see FIG. 20).
  B. Library 1 Calculations—Performed with PDA™
  The first combinatorial library was generated using the PDA™ simulation package. In this package, ligands are incorporated as part of the "template", which restricts the number of ligand states per simulation to 1. Therefore, the hydroxyl rotamers on the adenine diol were arbitrary for this set of calculations. Furthermore, no charges were created for the NAD. The first set of calculations included several amino acid possibilities at position 189. For all subsequent calculations, the identity at this position was restricted to Histidine.

C. Library 1 Definition

The rationale for library 1 was based on a combination of (i) quality of residues as predicted by ORBIT (based on probability tables generated by an ORBIT monte carlo simulation); (ii) structural intuition; and (iii) an emphasis on sampling a diversity of amino acid properties. At all positions, the wild type residue was included in the library. The most intriguing aspects of the library are various potential hydrogen-bonding interactions between side chains and the cofactor, giving rise to residues EDT at position 127, QE at position 195, EQ at position 217, and E at position 255. Because most NADH-utilizing enzymes contain an interaction between a carboxylic side chain and the adenine diol, the prediction of Q and E at position 195 is encouraging.

TRR Library 1:
127 LEDTA
165 IML
166 G
167 G
189 H
190 RYM
191 RQ
195 RYQE
217 SEQ
255 IE D. Library 2 Calculations—Performed with SPA Several simulations, using various cofactor conformations and sampling strategies, were performed for the development of library 2.

(i) The first set of simulations was performed using the NAD_TDF cofactor conformation for the heavy atom coordinates. Using this conformation, and 36 (6×6) hydroxyl rotamer combinations on the adenine diol, simulations were performed with either backbone ensemble or sub-rotamer sampling strategies.

(ii) The second set of simulations was performed using the NAD_GRB cofactor conformation for the heavy atom coordinates. Using this conformation, and 36 (6×6) hydroxyl rotamer combinations on the adenine diol, simulations were performed with either backbone ensemble or sub-rotamer sampling strategies.

E. Library 2 Definition

The rationale for library 2 was based on a combination of (i) quality of residues as predicted by SPA (based on output free energy matrices and comparison of matrices from different simulations); (ii) structural intuition; (iii) an emphasis on sampling a diversity of amino acid properties; and (iv) feedback from Library 1 screens. At all positions, the wild type residue was included in the library. As before, the most intriguing aspects of the library are various potential hydrogen-bonding interactions between side chains and the cofactor. However, because an alternative cofactor conformer was used in these calculations, new sets of interactions are predicted by SPA, giving rise to residues Q at position 127, S at position 167, TN at position 195 (FIGS. 3A, B), D at position 217, and E at position 255. The S167 (FIG. 3C) was chosen despite a high free energy value, based on its predicted ability to hydrogen bond to the AO2* oxygen of the adenine diol and the supposition that a small movement would relieve the van der Waals clash. An additional residue N at position 169 was added to this library, based on the possibility that neutralizing the negative charge at this position would assist in improving binding affinity of the cofactor (note that N is a conservative mutation as it is found in the *E coli* TRR).

Most of the residues in library 2 were chosen based on simulations with NAD_GRB. However, I195 was added based on a high propensity for this residue in SPA calculations using the NAD_TDF cofactor conformation.

TRR Library 2:

| | | | | | | | |
|---|---|---|---|---|---|---|---|
| 126 | 123 | 118 | R | | | | 1 |
| 127 | 124 | 119 | L | Q | | | 2 |
| 128 | 125 | 120 | S | | | | 1 |
| 164 | 161 | 150 | V | | | | 1 |
| 165 | 162 | 151 | I | M | L | | 3 |
| 166 | 163 | 152 | G | | | | 1 |
| 167 | 164 | 153 | G | S | | | 2 |
| 168 | 165 | 154 | G | | | | 1 |
| 169 | 166 | 155 | D | N | | | 2 |
| 170 | 167 | 156 | S | | | | 1 |
| 189 | 186 | 175 | H | | | | 1 |
| 190 | 187 | 176 | R | K | Q | | 3 |
| 191 | 188 | 177 | R | Y | E | L | 4 |
| 192 | 189 | 178 | D | | | | 1 |
| 193 | 190 | 179 | A | | | | 1 |
| 194 | 191 | 180 | F | | | | 1 |
| 195 | 192 | 181 | R | T | N | I | 4 |
| 196 | 193 | 182 | A | | | | 1 |
| 216 | 213 | 202 | S | | | | 1 |
| 217 | 214 | 203 | S | D | | | 2 |
| 218 | 215 | 204 | V | | | | 1 |
| 254 | 251 | 242 | A | | | | 1 |
| 255 | 252 | 243 | I | | | | 1 |
| 256 | 253 | 244 | G | | | | 1 |
| | | | | | | | 2304 |

Assays

Expression

1. The NTR coding region cloned in pET29 is expressed in BL21 Star (Invitrogen) cells. The volumes described here are typical for getting >50 ug of purified protein, and can be either scaled up or down based on requirements.
2. Inoculate colonies in a 96-deep well plate containing 1.5 ml CG+Kanamycin (100 ug/ml), inoculate appropriate controls. Grow overnight cultures at 37° C., 250 rpm
3. Next day, inoculate 200 µl of overnight cultures in 5 ml CG+Kanamycin (100 ug/ml) in 4×24-well plate for each 96 deep well plate. Grow at 30° C., 250 rpm, for 3 hrs
4. Make glycerol stocks from remaining overnight cultures and freeze at −80° C.
5. Induce the 5 ml cultures with 1M IPTG to final concentration of 1 mM. Grow overnight at 30° C., 250 rpm
6. Next day, spin down the cells at maximum speed (Avanti J-20, 5300 rpm) for 10 min. Discard supernatant, pellets can be frozen at −80° C. or proceed to S.tag Purification procedures S. Tag Purification For 96-Well Plate (96 Samples (from Cell Pellets; Novagen, Cat #69232-3)

The S. Tag Thrombin Purification Kit uses a unique strategy that employs Biotinylated Thrombin, which enables simple and specific removal of the enzyme after digestion with Streptavidin Agarose. The standard protocol calls for batch-wise binding to S-protein Agarose, washing, treatment with Biotinylated Thrombin, and capture with Streptavidin Agarose, leaving the purified protein in solution.

Kit Components

| Components | Provided Volume | Vol for 1 kit/24 samples |
|---|---|---|
| S-protein Agarose (50% slurry in 50 mM Tris-HCl, pH 7.5, 150 mM NaCl, 1 mM EDTA, 0.02% sodium azide) | 2 ml | 167 µl slurry/sample |
| 10X Bind/Wash Buffer (200 mM Tris-HCl pH 7.5, 1.5 M NaCl, 1% Triton X-100) | 3 × 5 ml | 100 ml of 1X 1 ml/sample |
| 10X Thrombin Cleavage Buffer (200 mM Tris-HCl pH 8.4, 1.5 M NaCl, 25 mM $CaCl_2$) | 3 ml | 30 ml of 1X 400 µl/sample |
| Biotinylated Thrombin | 50 U (1.5 U/µl) | 25 U (16.6 µl) 1 U (0.66 µl)/sample |
| Streptavidin Agarose (50% slurry in phosphate buffer, pH 7.5, 0.02% sodium azide) | 2 × 0.4 ml | 1.6 ml slurry 60 µl slurry/sample |

Additional Materials:
  Whatman Unifilter, 96-well, 800 µl (Fisher, cat #PF7700-2804)
  Bug Buster Protein Extraction Reagent (VWR, cat #80500-208)

Protocol (5 ml Expression Cultures)
 1. Thaw frozen pellets (5 ml) at RT for ~30 min
 2. Add 500 µl of Bug Buster HT, vortex to resuspend pellets and shake at RT for 20 min
 3. Spin at max speed or 3000×g for 20 min. Transfer supernatant (cell lysate) containing soluble proteins to a new plate.
 4. Use 150 µl of cell lysate for purification, save remainder for later use
    For 150 µl
    Adjust Tris-HCl and NaCl concentration to 20 mM Tris and 150 mM NaCl, pH7.5

| 150 µl | Bug Buster | ×100 |
| 10 µl | 1 M Tris-HCl (final 20 mM) | 1 ml |
| 15 µl | 5 M NaCl (final 0.15 M) | 1.5 ml |
| 325 µl | $H_2O$ | 32.5 ml |
| 500 µl | total | aliquot 350 µl mix |

5. Seal filter plate bottom with aluminum tape
 6. Add 167 µl of S-protein agarose mix using wide mouth tips
 7. Add lysate (adjusted) to filter plate, seal plate with aluminum tape
 8. Bind at RT for 30 min–1 hr on an orbital shaker (Place plate on the side—Do not shake vigorously as this will tend to denature protein)
 9. Remove aluminum tape from the bottom, apply vacuum
 10. Wash 2 times with 500 µl of 1× Bind/Wash Buffer, apply vacuum
 11. Equilibrate 2 times with 1× Thrombin Cleavage Buffer with ~1× slurry volume=200 µl, apply very low vacuum
 12. Re-seal filter plate bottom with aluminum foil
 13. Make a mix of 1× Thrombin Cleavabe Buffer and Biotinylated Thrombin
   Master Mix

| Reagents | 1 Kit for 24 samples | |
|---|---|---|
| | each | X100 |
| 1X Thrombin Cleavage Buffer | 80 µl | 8 µl |
| Biotinylated Thrombin (1.5 U/µl) | 0.66 µl | 66 µl |
| Aliquot | | 80.7 µl |

14. Gently shake tubes at RT for 1–2 hr on micromixer setting=5, amplitude=4
 15. Add 60 µl slurry of Streptavidin Agarose
 16. Incubate on orbital shaker at RT for 10 min
 17. Remove foil seal from the bottom of the filter plate
 18. Spin at 500× g, 2 min
 19. To elute more protein, add 80 µl of 1× cleavage buffer, spin at 500×g, 2 min
 20. Add equal volume of 50% glycerol, mix really well and store at 4° C. temporary, for long-term storage, freeze at −80° C.

BCA Assay

BCA Protein Assay Reagent Kit (Pierce, Cat #23227)
 1. Preparation of standards and working reagent
   a. Standards (working range is 0.125–2 µg/µl)

| Tube | Vol of Diluent (µl) | Volume of BSA | Final BCA Concentration (µg/µl) |
|---|---|---|---|
| A | 0 | 300 µl stock | 2.000 |
| B | 125 | 375 µl stock | 1.500 |
| C | 325 | 325 µl stock | 1.000 |
| D | 175 | 175 µl of B | 0.750 |
| E | 325 | 325 µl of C | 0.500 |
| F | 325 | 325 µl of E | 0.250 |
| G | 325 | 325 µl of F | 0.125 |
| H | 400 | 100 µl of G | 0.025 |
| I | 400 | 0 µl | 0.000 = blank |

For assay: 5 µl of each standard+20 µl of $ddH_2O$=25 µl total
   b. Working reagents
    Mix 50 ml of Reagent A with 1 ml of Reagent B
    *The Working reagent is stable for several days when stored in a closed container at room temperature
 2. Preparation of samples in 96-well plate.
   5 µl of purified protein (from step 20 of Purification procedure)
   20 µl of $ddH_2O$
   Mix well
 3. Assay procedure
   a. Add 200 µl of Working Reagent to each well containing 25 µl of standards and samples
   b. Mix plate thoroughly on a plate shaker for 30 seconds
   c. Cover plate with aluminum foil tape
   d. Incubate at 37° C. for 30 minutes
   e. Cool plate to room temperature
   f. Measure the absorbance at 562 nm on a plate reader
 4. Use Excel for standard curve plotting and determine protein concentration of samples 5. Normalize protein concentration for assay
   a. Run a protein gel of normalized protein to confirm concentration
   b. Stain with SYPRO Orange for 30 min–1 hr (and/or Coomassie blue overnight)
   c. Visualize gel on Apha Innotech Corporation Imager
   d. Perform densitometry using Kodak 1D 3.5 Network software Thioredoxin Reductase Assay
1. Assay is set up in 384 microtiter plates with 50 μl final volume per assay/well: Upto 4×96 well plate into one 384 plate, specific pattern to be noted at time of transfer.
2. Transfer 5 μl of normalized protein samples to 384 microtiter plate wells. NADPH or NADH at 1.2 mM (or other appropriate concentrations), and 2 μM of Purified Thioredoxin substrate is used in assay.

| Prepare assay mix: | 1 rxn | 300 rxn |
|---|---|---|
| ddH$_2$O | 35.1 μl | 10.53 ml |
| 1 M Tris pH 8.0 | 5.0 μl | 1.5 ml |
| 0.5 M EDTA | 1.0 μl | 300 μl |
| 20 mM DTNB | 0.5 μl | 150 μl |
| 25 mM NADPH or NADH | 2.4 μl | 720 μl |
| 100 μM Purified Thioredoxin | 1 μl | 300 μl |
| Total | 45 μl | 13.5 ml |

*Add NADH or NADPH and Thioredoxin substrate immediately before adding assay mix to supernatant to be tested 4. Use Titertek Multidrop 384 to add 45 μl of assay mix
5. Immediately place plate in Spectramax plate reader to begin data collection
6. For measurement of kinetic parameters (Kcat and Km) the following substrate concentration ranges were generally used:
   NADPH: 0.00, 0.01, 0.02, 0.04, 0.08, 0.15, 0.3, 0.6, 1.2, 2.5, 5.0 & 10.0 mM
   NADH: 0.02, 0.04, 0.08, 0.15, 0.3, 0.6, 1.2, 2.5, 5.0, 10.0 & 20.0 mM.
   Initial reaction rate in the linear range was determined for each concentration. The data was analyzed using GraphPad Prism software to fit a standard Michaelis-Menton equation.

Preparation of Thioredoxin h (N Terminal His Tag) for Assay Use

Culture Preparation:
1. Inoculate 2 liter expression culture with overnight culture of Thioredoxin-codon opt.*e-coli*/pET28b in BL21 Star (DE3) expression cells. This yields >100 mgs of purified protein.
2. After growth period, induce cells with 1M IPTG for a final concentration of 1 mM IPTG. Grow overnight at 30° C., 250 rpm.
3. Next day, spin down the 2 L culture into 20 50 ml Falcon tubes and discard the supernatant leaving just the pellet from 100 ml of culture. Freeze pellets at –80° C. before continuing with supernatant preparation and His-tag purification.

Supernatant Preparation:
1. Resuspend 20 pellets in 1 ml Bugbuster each and shake at 250 rpm, room temperature for 20 min.
2. Spin down cells and combine supernatants into a 50 ml Falcon tube. Add equal volume of 2× Loading buffer with 2-mercaptoethanol. Proceed with purification.

His-tag Protein Purification:
1. Add 6 μl Clontech TALON Superflow resin suspension to four 50 ml Falcon tubes.
2. Wash resin with 30 ml of 1× Loading buffer twice
3. Bind protein to resin by gently agitating at room temperature for 20 min.
4. Wash resin in 30 ml of 1× Loading buffer at room temperature for 10 min.
5. Resuspend resin in 3 ml of 1× Loading buffer.
6. Combine suspensions from all four tubes into one Clontech 10 ml gravity flow column.
7. Wash resin with 15 ml of 1× Loading buffer.
8. Resuspend resin in 20 ml of 250 mM imidazole elution buffer. Elute protein into a 50 ml tube twice.
9. Continue with imidazole removal by filtration and sample concentration or freeze at –20° C. for later use.

Filtration and Concentration of Purified Thioredoxin:
1. Run purified protein sample through Millipore Ultrafree-4 Biomax 5K filter tubes.
2. Wash samples three times with Filtration Wash buffer.
3. Combine concentrated protein samples together. Perform a BCA assay to determine concentration and then dilute to 100 uM with 50% glycerol, 20 mM Tris-HCl pH 8.0.

2× Loading Buffer
100 mM NaPO4 pH 8.0
10 mM Tris, pH 8.0
600 mM NaCl
20 mM Imidazole
10% Ethylene glycol
For 2× Loading buffer with 2 mM 2-mercaptoethanol, add 0.156 ul/ml 250 mM Imidazole Elution Buffer
50 mM NaPO4 pH 8.0
5 mM Tris, pH 8.0
200 mM NaCl
250 mM Imidazole
10% Ethylene glycol Filtration Buffer (for Imidazole Removal)
50 mM NaPO4
10 mM Tris, pH 8.0
200 mM NaCl
10% Ethylene glycol
ddH20

Example 2

Transformation of Plants with Variant TR Proteins

Overview

A gene encoding an oleosin-TR fusion protein, an oleosin-TR-reductase fusion protein or an oleosin-hybrid TR-reductase/TR-reductase fusion protein can be incorporated into plant cells using conventional recombinant DNA technology. Generally, this involves inserting a DNA molecule encoding an oleosin-TR-reductase fusion protein, an oleosin-TR-reductase fusion protein or an oleosin-hybrid TR/TR-reductase fusion protein into an expression system as described above.

Breeding

Plants expressing an oleosin-TR fusion protein, an oleosin-TR-reductase fusion protein or an oleosin-hybrid TR/TR-reductase fusion protein, in combination with other characteristics important for production and quality, can be incorporated into plant lines through breeding approaches and techniques known in the art. Where a plant expressing an oleosin-TR fusion protein, an oleosin-TR-reductase fusion protein or an oleosin-hybrid TR/TR-reductase fusion protein is obtained, the transgene is moved into commercial varieties using traditional breeding techniques without the need for genetically engineering the allele and transforming it into the plant.

Plants having the capacity for apomictic reproduction, in which maternal tissue gives rise to offspring, can be transformed to express an oleosin-R fusion protein, an oleosin-TR-reductase fusion protein or an oleosin-hybrid TR/TR-reductase fusion protein, and the introduced alleles can be maintained in desired backgrounds by apomictic breeding.

Isolation of TR and TR-Reductase Genes and in vitro Assays

In one embodiment, TR genes from *Arabidopsis*, wheat, a mammalian source such as calf and *E. coli* can be isolated and expressed in *E. coli* using bacterial expression vectors, and the resulting protein product can be purified. In another embodiment, TR-reductase genes from *Arabidopsis* and *E. coli* can be isolated, expressed in *E. coli* and purified. In addition, the TR/TR-reductase gene can be isolated/obtained from *Mycobacterium leprae* and expressed in *E. coli* and purified. In a preferred embodiment, *M. leprae* codons may be altered for optimization in any given host, such as an *E. coli* host cell or a plant species. Codon usage tables for many organisms are known and available, permitting codon optimization of coding sequences tailored for a particular host.

In another embodiment TR-reductases with altered cofactor specificity are prepared using targeted mutagenesis or random mutagenesis, and tested for specific mutations at the cofactor binding site (Shiraishi, et al. (1998) *Arch Biochem Biophys* 358 (1): 104–115; Galkin et al. (1997) *Protein Eng* 10(6): 687–690); Carugo et al. (1997) *Proteins* 28(1):10–28; Hurley et al. (1996) *Biochemistry* 35(18):5670–8; and/or by addition of organic solvent (Holmberg et al. (1999) *Protein Eng* 12 (10): 851–856). Determination of mutations could be assisted by computer programs such as the one developed by Mayo and Dahiyat (*Chem & Eng News* Oct. 6, 1997, pages 9–10). Each of the foregoing references is incorporated herein by reference in its entirety.

Combinations of different TRs and TR-reductases are used in a matrix to determine which TR and TR-reductase combination is most effective in the reduction of wheat storage proteins and milk storage protein β-lactoglobulin in vitro. Preferably, a combination of TR and TR-reductase are tested These experiments are carried out as described in Del Val et al. ((1999) *Jnl Allerg Clin Immunol* 103:690–697). Inbred high-IgE-responder atopic dogs are obtained and further prepared by sensitization with commercial extracts of food preparations including milk and wheat. Skin tests are performed using the Type I hypersensitivity reaction. Evans blue dye is injected intravenously shortly before skin testing. Aliquots of wheat gruel, whole cow's milk extract and pure β-lactoglobulin are injected intradermally. Skin tests are read blindly by scoring 2 perpendicular diameters of each blue spot. The ability of oleosin-TR, oleosin-TR-reductase and combinations thereof to affect the allergic response is measured in the presence and absence of exogenous NADPH or NADH.

Construction of Plant Expression Vectors

The *Arabidopsis* TR and TR-reductase gene sequences have been published (Rivera-Madrid et al. (1995) *Proc Natl Acad Sci USA* 92:5620–5624; Jacquot et al. (1994) *J Mol Biol* 235:1357–1363), and these genes can be isolated by PCR.

In one embodiment, both the *Arabidopsis* TR and TR-reductase genes are translationally fused to both the N- and C-terminal end of oleosin. This open reading frame is under transcriptional control of appropriate promoter and terminator sequences for expression in plants. In a preferred embodiment, the phaseolin promoter and terminator sequences are used to create *Arabidopsis* TR (ATR) and *Arabidopsis* TR-reductase (ATRR) constructs.

Expression in *Arabidopsis*

In one embodiment, *Arabidopsis* is used as a model system for the initial testing of oleosin-ATR and oleosin-ATRR expression constructs. Seed of *Arabidopsis* contain oleosin-coated oil bodies very similar to crop species, especially oilseed crop species, that can be used for commercial production of TR. Expression of oleosin-TR and oleosin-TR-reductase in *Arabidopsis* is used to obtain oleosin-TR and oleosin-TR-reductase fusions in oil bodies and to determine whether these fusion proteins are biologically active. Both N- and C-terminal fusions of both TR and TR-reductase to oleosin are made and tested. In a further embodiment, an oleosin fusion to the natural TR/TR-reductase fusion gene from *M. leprae* is tested. Accumulation of these fusion proteins is quantified using Western blotting, utilizing antibodies specific for oleosin and/or TR and TR-reductase. *Arabidopsis* is useful for this purpose since the time required to regenerate and grow transformed *Arabidopsis* plants and determine transgene expression and accumulation of expressed products in seeds is much shorter than for most crop species.

Construction of Plant Expression Vectors

Plant expression vectors are constructed using other genes encoding TR and TR-reductase including, but not limited to, TR genes from wheat, TR genes from a mammalian source such as calf, the TR gene from *E. coli.;* the TR-reductase gene from *E. coli;* and the TR/TR-reductase gene from *M. leprae*. Either or both of these genes are translationally fused to both the N and C-terminal end of oleosin. The open reading frame of any such construct is under the transcriptional control of appropriate promoter and terminator sequences. In a preferred embodiment, the phaseolin promoter and terminator sequences are used to construct plant expression vectors which are designated as TR' and TR-reductase. Even more preferably, the phaseolin promoter and terminator sequences are used to construct plant expression vectors which are designated as TR' and TR-reductase'.

Expression in Safflower

Plant transformation vectors as described above are used to transform safflower using methods known to those skilled in the art. In a preferred embodiment, safflower is transformed by a method adapted from the method disclosed by Baker and Dyer (*Plant Cell Rep* (1996) 16:106–110). Expression is assayed using Northern and Western blotting. The ability of the TR' and TR-reductase' constructs to reduce wheat storage proteins and milk storage protein β-lactoglobulin is tested. A minimum of 25 independently transformed transgenic safflower plants for each construct is generated. All the transgenic target crop plants are tested for oleosin-TR' and oleosin-TR-reductase' expression. The results from this analysis indicate which transformation event results in the highest and/or most optimal TR' or TR-reductase' activity. Transgenic lines transformed with this construct are subjected to further analyses. The quantity of TR' and TR-reductase' is determined using quantitative Western blotting analysis. The specific activity of the oleosin fusions is compared to the specific activity of the "free" TR' and TR-reductase' produced in *E. coli.*

Plant lines with the highest expression are propagated. Homozygotes and double haploid plants can be produced that possess a stable genotype to ensure stable transgene inheritance in subsequent generations.

Preparation of Biotinylated TR

In one embodiment, TR can be biotinylated in vitro by chemical modification of the lysine residues using chemical agents such as biotinyl-N-hydroxysuccinimide ester. As an alternate embodiment, an in vivo, site-specific biotinylation utilizing a biotin-domain peptide from the biotin carboxy carrier protein of *E. coli* acetyl-CoA carboxylase may be used as described by Smith et al. ((1998) *Nuc Acid Res* 26:1414–1420). A recombinant thioredoxin capable of being biotinylated in vivo by the *E. coli* host endogenous biotinylation machinery (BIOTRX) is constructed by inserting an oligonucleotide encoding a 23 amino acid biotinylation recognition peptide in-frame at the 5'-end of *E coli* trxA, creating the construct pBIOTRX. Cells containing the pBIOTRX plasmid are grown in the absence of exogenous biotin and the amount and solubility of BIOTRX protein is determined. Up to 10% of total cellular protein is found to be BIOTRX protein, while a low amount of tritiated biotin is incorporated into BIOTRX protein and BIOTRX binding to immobilized avidin or immobilized avidin-alkaline-phosphatase is low. Addition of 10 μg/ml biotin to the pre-induction medium of pBIOTRX-transformed cells results in an improvement in the overall extent of biotin incorporation.

Preparation of Biotinylated Oil Bodies-TR Mixtures

Avidin or strepavidin are used to link the biotinylated TR to biotinylated oil bodies. Purified biotinylated TR is mixed with biotinylated oil bodies at different ratios. The efficacy of these mixtures to reduce allergenicity and improve dough quality in wheat is tested as well as the efficacy of these mixtures to reduce allergenicity in milk preparations. The controls include wild type safflower oil bodies and wild type safflower oil bodies mixed, but not linked, with TR.

SEQUENCE LISTING (208 sequences)

SEQ ID NO: 1 - protein, 155 aa, Escherichia coli
GTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGN

SEQ ID NO: 2 - protein, 154 aa, Bacillus subtillis
SEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGD

SEQ ID NO: 3 - protein, 162 aa, Mycobacterium leprae
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGD

SEQ ID NO: 4 - protein, 163 aa, Sarccharomyces cerevisiae
VHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGD

SEQ ID NO: 5 - protein, 162 aa, Neurospora crassa
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGD

SEQ ID NO: 6 - protein, 169 aa, Arabidopsis thaliana
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGD

SEQ ID NO: 7 - protein, 216 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGV

SEQ ID NO: 8 - protein, 17 aa, Escherichia coli
VEEALYLSNIASEVHLI

SEQ ID NO: 9 - protein, 17 aa, Bacillus subtillis
VEEGVYLTRFASKVTIV

SEQ ID NO: 10 - protein, 17 aa, Mycobacterium leprae
MEEALFLTRFARSVTLV

SEQ ID NO: 11 - protein, 17 aa, Sarccharomyces cerevisiae
CEEAQFLTKYGSKVFML

SEQ ID NO: 12 - protein, 17 aa, Neurospora crassa
AEEAMYLTKYGSHVTVL

SEQ ID NO: 13 - protein, 17 aa, Arabidopsis thaliana
MEEANFLTKYGSKVYII

SEQ ID NO: 14 - protein, 30 aa, Homo Sapiens
MVRSILLRGFDQDMANKIGEHMEEHGIKFI

SEQ ID NO: 15 - protein, 3 aa, Escherichia coli
DGF

SEQ ID NO: 16 - protein, 3 aa, Bacillus subtillis
DKL

SEQ ID NO: 17 - protein, 3 aa, Mycobacterium leprae
DEF

SEQ ID NO: 18 - protein, 3 aa, Sarccharomyces cerevisiae
DHL

SEQ ID NO: 19 - protein, 3 aa, Neurospora crassa
DKL

SEQ ID NO: 20 - protein, 3 aa, Arabidopsis thaliana
DAF

SEQ ID NO: 21 - protein, 3 aa, Homo Sapiens
VPI

SEQ ID NO: 22 - protein, 139 aa, Escherichia coli
AEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 23 - protein, 135 aa, Bacillus subtillis
AQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 24 - protein, 52 aa, Mycobacterium leprae
ASKIMLGRARNNDKIKFITNHTVVAVNGYTTVTGLRLRNTTTGEETTLVVTG

SEQ ID NO: 25 - protein, 129 aa, Sarccharomyces cerevisiae
ASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 26 - protein, 283 aa, Neurospora crassa
ASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNLSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 27 - protein, 138 aa, Arabidopsis thaliana
ASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 28 - protein, 323 aa, Homo Sapiens [sequence omitted]

SEQ ID NO: 29 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattgggtggatgcttttcgggcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 30 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattggatggatgcttttggtgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 31 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattggattgatgctttttctgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 32 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattggatggatgctttttcggcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 33 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattggttggatgctttttctgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 34 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattggcgtgatgcttttactgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 35 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccatcgctacgatgcttttaacgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 36 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccatcgctttgatgcttttaacgcggctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 37 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccatcgctttgatgcttttaacgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 38 - DNA, 6357 bp, Arabidopsis thaliana
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccatcgccgcgatgcttttcgtgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 39 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattgggtggatgcttttggggcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgattgagtcgacaagcttgcggccgcac

SEQ ID NO: 40 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattggagggatgcttttagtgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgattgagtcgacaagcttgcggccgcac

SEQ ID NO: 41 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccattggtttgatgcttttcaggcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgattgagtcgacaagcttgcggccgcac

SEQ ID NO: 42 - DNA, 6357 bp, Arabidopsis thaliana
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccataggagagatgcttttagagcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgattgagtcgacaagcttgcggccgcac

SEQ ID NO: 43 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatgggtggaggcgattcagcaatggaagaagcaaactttcttacaaaatatggatccaaagtgtatataatccatcgctacgatgcttttaatgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgattgagtcgacaagcttgcggccgcac

SEQ ID NO: 44 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgctgggtggaggcgattcagcaatggaagaagcaaactttcttacaaaatatggatccaaagtgtatataatccatcgctacgatgcttttaatgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgattgagtcgacaagcttgcggccgcac

SEQ ID NO: 45 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccatcgctacgatgcttttaatgcgtctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgattgagtcgacaagcttgcggccgcac

SEQ ID NO: 46 - DNA, 6357 bp, Artificial sequence
  synthetic
tcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcacgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatcgatctcgatcccgcgaaattaatacgactcactataggggaattgtgagcggataacaattcccctctagaaataattttgtttaactttaagaaggagatatacatatgaaagaaaccgctgctgctaaattcgaacgccagcacatggacagcccagatctgggtaccctggtgccacgcggttccatggctgatatcagatctaatggtctcgaaactcacaacacaaggctctgtatcgtaggaagtggcccagcggcacacacggcggcgatttacgcagctagggctgaacttaaacctcttctcttcgaaggatggatggctaacgacatcgctcccggtggtcaactaacaaccaccaccgacgtcgagaatttccccggatttccagaaggtattctcggagtagagctcactgacaaattccgtaaacaatcggagcgattcggtactacgatatttacagagacggtgacgaaagtcgatttctcttcgaaaccgtttaagctattcacagattccaaggccattctcgctgacgctgtgattctcgctactggagctgtggctaagcggcttagcttcgttggatctggtgaaggttctggaggtttctggaaccgtggaatctccgcatgcgctgtttgcgacggagctgctccgatattccgtaacaaacctcttgcggtgatcggtggaggcgattcagcaatggaagaagcaaactttcttacaaaatatggatccaaagtgtatataatccatcgctacgatgcttttaacgcggctaagattatgcagcagcgcgctttgtctaatcctaagattgatgtgatttggaactcgtctgttgtggaagcttatggagatggagaaagagatgtgcttggaggattgaaagtgaagaatgtggttaccggtgatgtttctgatttaaaagtttctggattgttctttgctattggtcatgagccagctaccaagtttttggatggtggtgttgagttagattcggatggttatgttgtcacgaagcctggtactacacagactagcgttcccggagttttcgctgcgggtgatgttcaggataagaagtataggcaagccatcactgctgcaggaactgggtgcatggcagctttggatgcagagcattacttacaagagattggatctcagcaaggtaagagtgatggagtcgacaagcttgcggccgcac

SEQ ID NO: 47 - protein, 381 aa, Arabidopsis thaliana
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHRRDAFRASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 48 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHRYDAFNASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 49 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHRYDAFNAAKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 50 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHRFDAFNASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 51 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHRFDAFNAAKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 52 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWRDAFTASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 53 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWLDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 54 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWMDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 55 - protein, 365 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWRDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 56 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWIDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 57 - protein, 365 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWFDAFQASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 58 - protein, 381 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWVDAFRASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 59 - protein, 481 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWMDAFGASKIMQQRALSNPKIDVIWNSSVVEAYGDGERDVLGGLKVKNVVTGDVSDLKVSGLFFAIGHEPATKFLDGGVDSAMEEANFLTKYGSKVYIIHWVDAFGASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSDGVDKLAAALEHHHHHH

SEQ ID NO: 60 - protein, 365 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHWVDAFGASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 61 - protein, 365 aa, Arabidopsis thaliana
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHRRDAFRASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 62 - protein, 365 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVIGGGDSAMEEANFLTKYGSKVYIIHRYDAFNASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 63 - protein, 365 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVLGGGDSAMEEANFLTKYGSKVYIIHRYDAFNASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 64 - protein, 365 aa, Artificial sequence
  synthetic
MKETAAAKFERQHMDSPDLGTLVPRGSMADIRSNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEGSGGFWNRGISACAVCDGAAPIFRNKPLAVMGGGDSAMEEANFLTKYGSKVYIIHRYDAFNASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 65 - protein, 320 aa, Escherichia coli
GTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 66 - protein, 315 aa, Bacillus subtilis
SEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHRRDKLRAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 67 - protein, 458 aa, Mycobacterium leprae
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHRRDEFRASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 68 - protein, 334 aa, Neurospora crassa
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVRKDKLRASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 69 - protein, 318 aa, Saccharomyces cerevisiae
VHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVRKDHLRASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 70 - protein, 342 aa, Saccharomyces cerevisiae
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVRKDHFRASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 71 - protein, 333 aa, Arabidopsis thaliana
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHRRDAFRASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 72 - protein, 383 aa, Arabidopsis thaliana
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHRRDTFRASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 73 - protein, 497 aa, Homo sapiens [sequence omitted]

SEQ ID NO: 74 - protein, 301 aa, Methanococcus jannaschii
MIHDTIIIGAGPGGLTAGIYAMRGKLNALCIEKENAGGRIAEAGIVENYPGFEEIRGYELAEKFKNHAEKFKLPIIYDEVIKIETKERPFKVITKNSEYLTKTIVIATGTKPKKLGLNEDKFIGRGISYCTMCDAFFYLNKEVIVIGRDTPAIMSAINLKDIAKKVIVITDKSELKAAESIMLDKLKEANNVEIIYNAKPLEIVGEERAEGVKISVNGKEEIIKADGIFISLGHVPNTEFLKDSGIELDKKGFIKTDENCRTNIDGIYAVGDVRGGVMQVAKAVGDGCVAMANIIKYLQKL

SEQ ID NO: 75 - protein, 300 aa, Amhaeoglobus fulgidus
MYDVAIIGGGPAGLTAALYSARYGLKTVFFETVDPVSQLSLAAKIENYPGFEGSGMELLEKMKEQAVKAGAEWKLEKVERVERNGETFTVIAEGGEYEAKAIIVATGGKHKEAGIEGESAFIGRGVSYCATCDGNFFRGKKVIVYGSGKEAIEDAIYLHDIGCEVTIVSRTPSFRAEKALVEEVEKRGIPVHYSTTIRKIIGSGKVEKVVAYNREKKEEFEIEADGIFVAIGMRPATDVVAELGVERDSMGYIKVDKEQRTNVEGVFAAGDCCDNPLKQVVTACGDGAVAAYSAYKYLTS

SEQ ID NO: 76 - protein, 7 aa, Artificial sequence
  cofactor specificity motif
  MISC_FEATURE (4)..(6): "Xaa" at positions 4 to 6 can be any amino acid
HQFXXXQ

SEQ ID NO: 77 - protein, 7 aa, Artificial sequence
  cofactor specificity motif
  MISC_FEATURE (4)..(6): "Xaa" at positions 4 to 6 can be any amino acid
EFAXXXK

SEQ ID NO: 78 - protein, 8 aa, Artificial sequence
  cofactor specificity motif
  MISC_FEATURE (4)..(7): "Xaa" at positions 4 to 7 can be any amino acid
EMFXXXXP

SEQ ID NO: 79 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWSILLTGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 80 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWRDAFTASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 81 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWKDKLTASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 82 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWKDHFTASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 83 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWKDHLTASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 84 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWRDEFTASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 85 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWRDKLTAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 86 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWRDGFTAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 87 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWRDTFTASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 88 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWLILLSGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 89 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWLDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 90 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWLDKLSASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 91 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWLDHFSASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 92 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWLDHLSASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 93 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWLDEFSASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 94 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWLDKLSAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 95 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWLDGFSAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 96 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWLDTFSASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 97 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVRYILLNGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 98 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHRYDAFNASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 99 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVRYDKLNASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 100 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVRYDHFNASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 101 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVRYDHLNASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 102 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHRYDEFNASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 103 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHRYDKLNAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 104 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHRYDGFNAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 105 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHRYDTFNASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 106 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWFILLQGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 107 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWFDAFQASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 108 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWFDKLQASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 109 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWFDHFQASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 110 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWFDHLQASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 111 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWFDEFQASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 112 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWFDKLQAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 113 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWFDGFQAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 114 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWFDTFQASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 115 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWLILLTGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 116 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWLDAFTASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 117 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWLDKLTASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 118 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWLDHFTASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 119 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWLDHLTASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 120 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWLDEFTASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 121 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWLDKLTAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 122 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWLDGFTAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 123 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWLDTFTASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 124 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWSILLSGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 125 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWRDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 126 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWKDKLSASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 127 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWKDHFSASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 128 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWKDHLSASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 129 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWRDEFSASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 130 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWRDKLSAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 131 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWRDGFSAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 132 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWRDTFSASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 133 - protein, 497 aa, Artificial sequence; identical to SEQ ID NO: 97
  Homo sapiens variant

SEQ ID NO: 134 - protein, 333 aa, Artificial sequence; identical to SEQ ID NO: 98
  Arabidopsis thaliana variant

SEQ ID NO: 135 - protein, 334 aa, Artificial sequence; identical to SEQ ID NO: 99
  Neurospora crassa variant

SEQ ID NO: 136 - protein, 342 aa, Artificial sequence; identical to SEQ ID NO: 100
  Sarccharomyces cerevisiae variant

SEQ ID NO: 137 - protein, 319 aa, Artificial sequence; identical to SEQ ID NO: 101
  Sarccharomyces cerevisiae variant

SEQ ID NO: 138 - protein, 458 aa, Artificial sequence; identical to SEQ ID NO: 102
  Mycobacterium leprae variant

SEQ ID NO: 139 - protein, 316 aa, Artificial sequence; identical to SEQ ID NO: 103
  Bacillus subtillis variant

SEQ ID NO: 140 - protein, 321 aa, Artificial sequence; identical to SEQ ID NO: 104
  Escherichia coli variant

SEQ ID NO: 141 - protein, 383 aa, Artificial sequence; identical to SEQ ID NO: 105
  Arabidopsis thaliana variant

SEQ ID NO: 142 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVRFILLNGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 143 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHRFDAFNASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 144 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVRFDKLNASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 145 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVRFDHFNASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 146 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVRFDHLNASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 147 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHRFDEFNASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 148 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHRFDKLNAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 149 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHRFDGFNAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 150 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHRFDTFNASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 151 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWMILLSGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 152 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWMDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 153 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWMDKLSASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 154 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWMDHFSASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 155 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWMDHLSASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 156 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWMDEFSASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 157 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWMDKLSAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 158 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWMDGFSAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 159 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWMDTFSASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 160 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWIILLSGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 161 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWIDAFSASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 162 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWIDKLSASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 163 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWIDHFSASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 164 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWIDHLSASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 165 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWIDEFSASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 166 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWIDKLSAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 167 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWIDGFSAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 168 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWIDTFSASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 169 - protein, 497 aa, Artificial sequence; identical to SEQ ID NO: 106
  Homo sapiens variant

SEQ ID NO: 170 - protein, 333 aa, Artificial sequence; identical to SEQ ID NO: 107
  Arabidopsis thaliana variant

SEQ ID NO: 171 - protein, 334 aa, Artificial sequence; identical to SEQ ID NO: 108
  Neurospora crassa variant

SEQ ID NO: 172 - protein, 342 aa, Artificial sequence; identical to SEQ ID NO: 109
  Sarccharomyces cerevisiae variant

SEQ ID NO: 173 - protein, 319 aa, Artificial sequence; identical to SEQ ID NO: 110
  Sarccharomyces cerevisiae variant

SEQ ID NO: 174 - protein, 457 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVWFDEFQASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 175 - protein, 316 aa, Artificial sequence; identical to SEQ ID NO: 112
  Bacillus subtillis variant

SEQ ID NO: 176 - protein, 321 aa, Artificial sequence; identical to SEQ ID NO: 113
  Escherichia coli variant

SEQ ID NO: 177 - protein, 383 aa, Artificial sequence; identical to SEQ ID NO: 114
  Arabidopsis thaliana variant

SEQ ID NO: 178 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWVILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 179 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWVDAFRASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 180 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWVDKLRASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 181 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWVDHFRASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 182 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWVDHLRASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 183 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWVDEFRASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 184 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWVDKLRAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 185 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWVDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 186 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWVDTFRASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 187 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWMILLGGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 188 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWMDAFGASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 189 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWMDKLGASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 190 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWMDHFGASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 191 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWMDHLGASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 192 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWMDEFGASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 193 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWMDKLGAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 194 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWMDGFGAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 195 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWMDTFGASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 196 - protein, 497 aa, Artificial sequence
  Homo sapiens variant
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAESFLIATGERPRYLGIPGDKEYCISSDDLFSLPYCPGKTLVVGASYVALECAGFLAGIGLGVTVMVWVILLGGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 197 - protein, 333 aa, Artificial sequence
  Arabidopsis thaliana variant
MNGLETHNTRLCIVGSGPAAHTAAIYAARAELKPLLFEGWMANDIAPGGQLTTTTDVENFPGFPEGILGVELTDKFRKQSERFGTTIFTETVTKVDFSSKPFKLFTDSKAILADAVILATGAVAKRLSFVGSGEASGGFWNRGISACAVCDGAAPIFRNKPLAVIGGGDSAMEEANFLTKYGSKVYIIHWVDAFGASKIMQQRALSNPKIDVIWNSSVVEAYGDGERDVLGGLKVKNVVTGDVSDLKVSGLFFAIGHEPATKFLDGGVELDSDGYVVTKPGTTQTSVPGVFAAGDVQDKKYRQAITAAGTGCMAALDAEHYLQEIGSQQGKSD

SEQ ID NO: 198 - protein, 334 aa, Artificial sequence
  Neurospora crassa variant
MHSKVVIIGSGPAAHTAAIYLARAELKPVLYEGFMANGIAAGGQLTTTTEIENFPGFPDGIMGQELMDKMKAQSERFGTQIISETVAKVDLSARPFKYATEWSPEEYHTADSIILATGASARRLHLPGEEKYWQNGISACAVCDGAVPIFRNKHLVVIGGGDSAAEEAMYLTKYGSHVTVLVWVDKLGASSIMAHRLLNHEKVTVRFNTVGVEVKGDDKGLMSHLVVKDVTTGKEETLEANGLFYAIGHDPATALVKGQLETDADGYVVTKPGTTLTSVEGVFAAGDVQDKRYRQAITSAGTGCMAALDAEKFLSEHEETPAEHRDTSAVQGNL

SEQ ID NO: 199 - protein, 342 aa, Artificial sequence
  Sarccharomyces cerevisiae variant
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVWVDHFGASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 200 - protein, 319 aa, Artificial sequence
  Sarccharomyces cerevisiae variant
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVWVDHLGASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 201 - protein, 458 aa, Artificial sequence
  Mycobacterium leprae variant
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHWVDEFGASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 202 - protein, 316 aa, Artificial sequence
  Bacillus subtillis variant
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHWVDKLGAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 203 - protein, 321 aa, Artificial sequence
  Escherichia coli variant
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHWVDGFGAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 204 - protein, 383 aa, Artificial sequence
  Arabidopsis thaliana variant
MCWISMSQSRFIIKSLFSTAGGFLLGSALSNPPSLATAFSSSSSSSSAAAAVDMETHKTKVCIVGSGPAAHTAAIYASRAELKPLLFEGWMANDIAPGGQLTTTTDVENFPGFPEGILGIDIVEKFRKQSERFGTTIFTETVNKVDFSSKPFKLFTDSRTVLADSVIISTGAVAKRLSFTGSGEGNGGFWNRGISACAVCDGAAPIFRNKPLVVIGGGDSAMEEANFLTKYGSKVYIIHWVDTFGASKIMQQRALSNPKIEVIWNSAVVEAYGDENGRVLGGLKVKNVVTGDVSDLKVSGLFFAIGHEPATKFLDGQLELDEDGYVVTKPGTTKTSVVGVFAAGDVQDKKYRQAITAAGTGCMAALDAEHYLQEIGSQEGKSD

SEQ ID NO: 205 - protein, 5 aa, Artificial sequence
  linker consensus sequence
GSGGS

SEQ ID NO: 206 - protein, 5 aa, Artificial sequence
  linker consensus sequence
GGGGS

SEQ ID NO: 207 - protein, 4 aa, Artificial sequence
  linker consensus sequence
GGGS

SEQ ID NO: 208 - protein, 13 aa, Artificial sequence
  synthetic
RYDAFNASKIMQQ

We claim:

1. A variant thioredoxin reductase (TR) protein with altered cofactor specificity as compared to a naturally occurring thioredoxin reductase protein comprising an isolated polypeptide molecule having the formula:

S1-A1-A2-S2-A3-A4-A5-S3-A6-S4 wherein a) S1 comprises SEQ ID NO:6;
b) S2 comprises SEQ ID NO:13;
c) S3 comprises SEQ ID NO:20;
d) S4 comprises SEQ ID NO:27;
e) A1 is the amino acid serine;
f) A2 is the amino acid is the amino acid alanine;
g) A3 is the amino acid is the amino acid histidine;
h) A4 is an amino acid moiety selected from the group consisting of arginine and tryptophan;
i) A5 is an amino acid moiety selected from the group consisting of arginine, valine, leucine, isoleucine, methionine, phenylalanine, and tyrosine;
j) A6 is an amino acid moiety selected from the group consisting of arginine, glycine, asparagine, glutamine, serine, and threonine, wherein only zero, one, or two of A4, A5 or A6 are arginine.

2. A variant thioredoxin reductase (TR) protein according to claim 1 wherein a) S1 comprises SEQ ID NO:6;
b) S2 comprises SEQ ID NO:13;
c) S3 comprises SEQ ID NO:20;
d) S4 comprises SEQ ID NO:27;
e) A1 is the amino acid serine;
f) A2 is the amino acid alanine;
g) A3 is the amino acid histidine;
h) A4 is the amino acid tryptophan;
A5 is the amino acid valine; and
A6 is the amino acid arginine.

3. A variant thioredoxin reductase (TR) protein according to claim 1 wherein a) S1 comprises SEQ ID NO:6;
b) S2 comprises SEQ ID NO:13;
c) S3 comprises SEQ ID NO:20;
d) S4 comprises SEQ ID NO:27;
e) A1 is the amino acid serine;
f) A2 is the amino acid alanine;
g) A3 is the amino acid histidine;
h) A4 is the amino acid tryptophan;
i) A5 is the amino acid methionine; and
j) A6 is the amino acid glycine.

4. A variant thioredoxin reductase (TR) protein according to claim 1 wherein a) S1 comprises SEQ ID NO:6;
b) S2 comprises SEQ ID NO:13;
c) S3 comprises SEQ ID NO:20;
d) S4 comprises SEQ ID NO:27;
e) A1 is the amino acid serine;
f) A2 is the amino acid alanine;
g) A3 is the amino acid histidine;
h) A4 is the amino acid tryptophan;
i) A5 is the amino acid isoleucine; and
j) A6 is the amino acid serine.

5. A variant thioredoxin reductase (TR) protein according to claim 1 wherein
  a) S1 comprises SEQ ID NO:6;
  b) S2 comprises SEQ ID NO:13;
  c) S3 comprises SEQ ID NO:20;
  d) S4 comprises SEQ ID NO:27;
  e) A1 is the amino acid serine;
  f) A2 is the amino acid alanine;
  g) A3 is the amino acid histidine;
  h) A4 is the amino acid tryptophan;
  i) A5 is the amino acid methionine; and
  j) A6 is the amino acid serine.

6. A variant thioredoxin reductase (TR) protein according to claim 1 wherein
  a) S1 comprises SEQ ID NO:6;
  b) S2 comprises SEQ ID NO:13;
  c) S3 comprises SEQ ID NQ:20;
  d) S4 comprises SEQ ID NO:27;
  e) A1 is the amino acid serine;
  f) A2 is the amino acid alanine;
  g) A3 is the amino acid histidine;
  h) A4 is the amino acid tryptophan;
  i) A5 is the amino acid leucine; and
  j) A6 is the amino acid serine.

7. A variant thioredoxin reductase (TR) protein according to claim 1 wherein
  a) S1 comprises SEQ ID NO:6;
  b) S2 comprises SEQ ID NO:13;
  c) S3 comprises SEQ ID NO:20;
  d) S4 comprises SEQ ID NO:27;
  e) A1 is the amino acid serine;
  f) A2 is the amino acid alanine;
  g) A3 is the amino acid histidine;
  h) A4 is the amino acid tryptophan;
  i) A5 is the amino acid arginine; and
  j) A6 is the amino acid threonine.

8. A variant thioredoxin reductase (TR) protein according to claim 1 wherein
  a) S1 comprises SEQ ID NO:6;
  b) S2 comprises SEQ ID NO:13;
  c) S3 comprises SEQ ID NO:20;
  d) S4 comprises SEQ ID NO:27;
  e) A1 is the amino acid serine;
  f) A2 is the amino acid alanine;
  g) A3 is the amino acid histidine;
  h) A4 is the amino acid tryptophan;
  i) A5 is the amino acid valine; and
  j) A6 is the amino acid glycine.

9. A variant thioredoxin reductase (TR) protein according to claim 1 wherein
  a) S1 comprises SEQ ID NO:6;
  b) S2 comprises SEQ ID NO:13;
  c) S3 comprises SEQ ID NO:20;
  d) S4 comprises SEQ ID NO:27;
  e) A1 is the amino acid serine;
  f) A2 is the amino acid alanine;
  g) A3 is the amino acid histidine;
  h) A4 is the amino acid arginine;
  i) A5 is the amino acid tyrosine; and
  j) A6 is the amino acid asparagine.

10. The polypeptide molecule according to any one of claims 1–9, wherein said co-factor towards NADH is altered.

11. The polypeptide molecule according to any one of claims 1–9, wherein said co-factor towards NADPH is altered.

* * * * *

UNITED STATES PATENT AND TRADEMARK OFFICE
CERTIFICATE OF CORRECTION

| | |
|---|---|
| PATENT NO. | : 7,071,307 B2 |
| APPLICATION NO. | : 10/141531 |
| DATED | : July 4, 2006 |
| INVENTOR(S) | : Dalmia et al. |

It is certified that error appears in the above-identified patent and that said Letters Patent is hereby corrected as shown below:

IN THE CLAIMS

Claim 2, Col. 76, line 41, before "A5" insert --i)--.

Claim 2, Col. 76, line 42, before "A6" insert --j)--.

Signed and Sealed this

Twenty-sixth Day of September, 2006

JON W. DUDAS
*Director of the United States Patent and Trademark Office*